US012612630B2

(12) United States Patent
Miyata et al.

(10) Patent No.: US 12,612,630 B2
(45) Date of Patent: Apr. 28, 2026

(54) COMPOSITIONS AND METHODS FOR SPLICING MODULATION OF UNC13A

(71) Applicant: Takeda Pharmaceutical Company Limited, Osaka (JP)

(72) Inventors: Kenichi Miyata, Fujisawa (JP); Masahiro Nogami, Fujisawa (JP); Akihiro Yokota, Fujisawa (JP); Rumiko Ochiai, Fujisawa (JP); Etsuko Shimobayashi, Fujisawa (JP); Naoki Tomita, Fujisawa (JP); Masato Niwa, Fujisawa (JP); Zhaoma Shu, Fujisawa (JP); Akiyoshi Kunugi, Fujisawa (JP); Tatsuya Hayama, Fujisawa (JP); Himari Yamazaki, Fujisawa (JP)

(73) Assignee: Takeda Pharmaceutical Company Limited, Osaka (JP)

( * ) Notice: Subject to any disclaimer, the term of this patent is extended or adjusted under 35 U.S.C. 154(b) by 0 days.

(21) Appl. No.: 19/070,094

(22) Filed: Mar. 4, 2025

(65) Prior Publication Data

US 2025/0283083 A1 Sep. 11, 2025

Related U.S. Application Data

(60) Provisional application No. 63/561,593, filed on Mar. 5, 2024.

(51) Int. Cl.
*C12N 15/113* (2010.01)

(52) U.S. Cl.
CPC ........ *C12N 15/113* (2013.01); *C12N 2310/11* (2013.01); *C12N 2310/315* (2013.01); *C12N 2310/3231* (2013.01); *C12N 2320/33* (2013.01)

(58) Field of Classification Search
CPC .............. C12N 15/113; C12N 2310/11; C12N 2310/315; C12N 2310/3231; C12N 2320/33
See application file for complete search history.

(56) References Cited

U.S. PATENT DOCUMENTS

| | | | |
|---|---|---|---|
| 7,361,468 | B2 | 4/2008 | Liu et al. |
| 12,084,657 | B2 | 9/2024 | Wang et al. |
| 2005/0042664 | A1 | 2/2005 | Wu et al. |
| 2022/0033818 | A1 | 2/2022 | Wang et al. |
| 2023/0125137 | A1 | 4/2023 | Chang et al. |
| 2024/0327837 | A1 | 10/2024 | Wang et al. |
| 2025/0051766 | A1 | 2/2025 | Hinckley et al. |
| 2025/0145996 | A1 | 5/2025 | Bastien et al. |
| 2025/0304964 | A1 | 10/2025 | Miyata et al. |

FOREIGN PATENT DOCUMENTS

| | | | |
|---|---|---|---|
| WO | WO 2022/018187 | A1 | 1/2022 |
| WO | WO 2022/122872 | A1 | 6/2022 |
| WO | WO 2022/216759 | A1 | 10/2022 |
| WO | WO 2022/246251 | A2 | 11/2022 |
| WO | WO 2023/004049 | A1 | 1/2023 |
| WO | WO 2023/102225 | A2 | 6/2023 |
| WO | WO 2023/102227 | A2 | 6/2023 |
| WO | WO 2023/102242 | A2 | 6/2023 |
| WO | WO 2023/104964 | A1 | 6/2023 |
| WO | WO 2023/118087 | A1 | 6/2023 |
| WO | WO 2023/222858 | A1 | 11/2023 |
| WO | WO 2024/011150 | A2 | 1/2024 |
| WO | WO 2024/077109 | A1 | 4/2024 |
| WO | WO 2024/155986 | A2 | 7/2024 |
| WO | WO 2024/178223 | A1 | 8/2024 |
| WO | WO 2024/249791 | A2 | 12/2024 |
| WO | WO 2024/249886 | A1 | 12/2024 |

OTHER PUBLICATIONS

Ma et al.("TDP-43 represses cryptic exon inclusion in the FTD-ALS gene UNC13A." Nature 603.7899 (2022): 124-130).*
Chen et al. ("UNC13A Gene Brings New Hope for ALS Disease-Modifying Drugs." Neuroscience Bulletin 38.11 (2022): 1431-1434).*
Brown et al. (Nature vol. 603 Mar. 3, 2022 131-162).*
Sciabola et al. ("PFRED: A computational platform for siRNA and antisense oligonucleotides design." PLoS One 16.1 (2021)).*
GenBank Gene ID 102123626; UNC13A unc-13 homolog A [Macaca fascicularis (crab-eating macaque)]. Last updated: May 28, 2025.
GenBank Gene ID 23025; UNC13A unc-13 homolog A [*Homo sapiens* (human)]. Last updated: May 3, 2025.
Genbank Submission; NCBI, Accession No. NC_052273.1; Macaca fascicularis isolate CE1976F chromosome 19, MFA1912RKSv2, whole genome shotgun sequence. Dec. 8, 2021.
Genbank Submission; NCBI, Accession No. NCBI Accession No. NC_000019.1; *Homo sapiens* chromosome 19, complete sequence. Aug. 29, 2002.
Genbank Submission; NCBI, Accession No. NG_052872.1; *Homo sapiens* unc-13 homolog A (UNC13A), RefSeqGene on chromosome 19. Feb. 18, 2024.
Genbank Submission; NCBI, Accession No. NM_001080421.3; *Homo sapiens* unc-13 homolog A (UNC13A), transcript variant 1, mRNA. Feb. 17, 2024.
Genbank Submission; NCBI, Accession No. NP_001073890.2; protein unc-13 homolog A isoform 1 [*Homo sapiens*]. Feb. 17, 2024.
Genbank Submission; NCBI, Accession No. XM_045380772.1; Predicted: Macaca fascicularis unc-13 homolog A (UNC13A), transcript variant X5, mRNA. Dec. 8, 2021.

(Continued)

*Primary Examiner* — Kimberly Chong
(74) *Attorney, Agent, or Firm* — Wolf, Greenfield & Sacks, P.C.

(57) ABSTRACT

Antisense oligonucleotides for splicing modulation of UNC13A (e.g., inhibiting inclusion of an UNC13A cryptic exon into an UNC13A mature mRNA), compositions including the antisense oligonucleotides, and methods of use are described. Also disclosed are pharmaceutical compositions including one or more antisense oligonucleotides and methods of treating an UNC13A-associated disease or a disease associated with TDP-43 dysfunction in a subject by administering the antisense oligonucleotides to the subject.

8 Claims, No Drawings

Specification includes a Sequence Listing.

(56) References Cited

OTHER PUBLICATIONS

Genbank Submission; NCBI, Accession No. XP_045236707.1; protein unc-13 homolog A isoform X5 [Macaca fascicularis]. Dec. 8, 2021.
Augustin et al., Munc 13-1 is essential for fusion competence of glutamatergic synaptic vesicles. Nature. Jul. 29, 1999;400(6743):457-61. doi: 10.1038/22768.
Brose et al., Mammalian homologues of Caenorhabditis elegans unc-13 gene define novel family of C2-domain proteins. J Biol Chem. Oct. 20, 1995;270(42):25273-80. doi: 10.1074/jbc.270.42.25273.
Brown et al., TDP-43 loss and ALS-risk SNPs drive mis-splicing and depletion of UNC13A. Nature. Mar. 2022;603(7899):131-137. doi: 10.1038/s41586-022-04436-3. Epub Feb. 23, 2022.
Burrell et al., The frontotemporal dementia-motor neuron disease continuum. Lancet. Aug. 27, 2016;388(10047):919-31. doi: 10.1016/S0140-6736(16)00737-6. Epub Mar. 14, 2016.
Engel et al., Loss of MUNC13-1 function causes microcephaly, cortical hyperexcitability, and fatal myasthenia. Neurol Genet. Sep. 8, 2016;2(5):e105. doi: 10.1212/NXG.0000000000000105. eCollection Oct. 2016.
Goldspiel et al., Human gene therapy. Clin Pharm. Jul. 1993;12(7):488-505.
Lipstein et al., Synaptic UNC13A protein variant causes increased neurotransmission and dyskinetic movement disorder. J Clin Invest. Mar. 1, 2017;127(3):1005-1018. doi: 10.1172/JCI90259. Epub Feb. 13, 2017.
Ma et al., TDP-43 represses cryptic exon inclusion in the FTD-ALS gene UNC13A. Nature. Mar. 2022;603(7899):124-130. doi: 10.1038/s41586-022-04424-7. Epub Feb. 3, 2022.
Meneses et al., TDP-43 Pathology in Alzheimer's Disease. Mol Neurodegener. Dec. 20, 2021;16(1):84. doi: 10.1186/s13024-021-00503-x.
Miller et al., Trial of Antisense Oligonucleotide Tofersen for SOD1 ALS. N Engl J Med. Sep. 22, 2022;387(12):1099-1110. doi: 10.1056/NEJMoa2204705.
Miller et al., Trial of Antisense Oligonucleotide Tofersen for SOD1 ALS. N Engl J Med. 2022. Supplementary Appendix. 40 pages.
Morgan et al., Human gene therapy. Annu Rev Biochem. 1993:62:191-217. doi: 10.1146/annurev.bi.62.070193.001203.
Mulligan, The basic science of gene therapy. Science. May 14, 1993;260(5110):926-32. doi: 10.1126/science.8493530.
Nelson et al., Limbic-predominant age-related TDP-43 encephalopathy (LATE): consensus working group report. Brain. Jun. 1, 2019;142(6):1503-1527. doi: 10.1093/brain/awz099.
Robinson, Gene Therapy-proceeding from laboratory to clinic. TIBTECH Biotechnology. May 1993; 11(5):155-215.
Ruffo et al., SOD-1 Variants in Amyotrophic Lateral Sclerosis: Systematic Re-Evaluation According to ACMG-AMP Guidelines. Genes (Basel). Mar. 18, 2022;13(3):537. doi: 10.3390/genes13030537.
Tolstoshev, Gene therapy, concepts, current trials and future directions. Annu Rev Pharmacol Toxicol. 1993:33:573-96. doi: 10.1146/annurev.pa.33.040193.003041.
Varoqueaux et al., Aberrant morphology and residual transmitter release at the Munc13-deficient mouse neuromuscular synapse. Mol Cell Biol. Jul. 2005;25(14):5973-84. doi: 10.1128/MCB.25.14.5973-5984.2005.
Varoqueaux et al., Total arrest of spontaneous and evoked synaptic transmission but normal synaptogenesis in the absence of Munc13-mediated vesicle priming. Proc Natl Acad Sci U S A. Jun. 25, 2002;99(13):9037-42. doi: 10.1073/pnas.122623799. Epub Jun. 17, 2002.
Wu et al., Delivery systems for gene therapy. Biotherapy. 1991;3(1):87-95. doi: 10.1007/BF02175102.
International Search Report and Written Opinion for Application No. PCT/IB2025/000078, mailed Jul. 21, 2025.
Ansari et al., Role of the UNC13 family in human diseases: A literature review. AIMS Neurosci. Dec. 6, 2023;10(4):388-400. doi: 10.3934/Neuroscience.2023029. eCollection 2023.
Pao et al., Dual masking of specific negative splicing regulatory elements resulted in maximal exon 7 inclusion of SMN2 gene. Mol Ther. Apr. 2014;22(4):854-61. doi: 10.1038/mt.2013.276. Epub Dec. 9, 2013.
Watanabe et al., Exon 44 skipping in Duchenne muscular dystrophy: NS-089/NCNP-02, a dual-targeting antisense oligonucleotide. Mol Ther Nucleic Acids. Sep. 20, 2023:34:102034. doi: 10.1016/j.omtn.2023.102034. eCollection Dec. 12, 2023.

* cited by examiner

COMPOSITIONS AND METHODS FOR SPLICING MODULATION OF UNC13A

RELATED APPLICATIONS

This application claims the benefit under 35 U.S.C. § 119(e) of U.S. Provisional Application Ser. No. 63/561,593, filed Mar. 5, 2024, entitled "COMPOSITIONS AND METHODS FOR SPLICING MODULATION OF UNC13A", the entire contents of which are incorporated herein by reference.

FIELD

The invention relates to compositions (e.g., antisense oligonucleotides) for splicing modulation and/or modulation of gene expression of UNC13A.

REFERENCE TO AN ELECTRONIC SEQUENCE LISTING

The contents of the electronic sequence listing (T083370053US01-SEQ-CBD.xml; Size: 3,049,839 bytes; and Date of Creation: Mar. 4, 2025) is herein incorporated by reference in its entirety.

BACKGROUND

Amyotrophic lateral sclerosis (ALS), also known as Lou Gehrig's disease, and frontotemporal dementia (FTD) are rare neurodegenerative diseases known as motor neuron diseases (MND). ALS is a terminal MND characterized by upper and lower motor neuron loss, which results in rapid deterioration of muscle function, and eventually death due to respiratory failure. FTD is characterized by progressive neuronal loss predominantly involving the frontal and temporal lobes, and generally presents as a behavioral or language disorder. Some patients with ALS also develop frontotemporal dementia (FTD). There is currently no known cure of ALS or FTD.

UNC13A is an essential protein for synaptic transmission and transmission at the neuromuscular junction (NMJ). Single nucleotide polymorphisms (SNPs), e.g., intronic SNPs, in UNC13A, have been shown to increase the risk of ALS and FTD. The SNPs have been shown to increase cryptic splicing and alter direct binding of RNA-binding protein TDP-43, which reduces the ability of TDP-43 to repress cryptic exon inclusion in UNC13A during RNA splicing. TDP-43 dysfunction has been shown to result in inclusion of a cryptic exon in an UNC13A mature mRNA. Cryptic exon inclusion in an UNC13A mature mRNA results in reduced UNC13A protein expression due to aberrant RNA degradation or the presence of premature stop codons.

Additional neurodegenerative diseases involving TDP-43 pathology include Alzheimer's disease and Limbic-Predominant Age-Related TDP-43 Encephalopathy (LATE).

SUMMARY

ALS and FTD patients could benefit from inhibiting inclusion of an UNC13A cryptic exon into an UNC13A mature mRNA. There is a need for compositions and methods for treating ALS and FTD, e.g., by inhibiting inclusion of an UNC13A cryptic exon into an UNC13A mature mRNA and/or restoring UNC13A expression in a cell in a subject with ALS or FTD.

The present disclosure, in some aspects, provides antisense oligonucleotides for splicing modulation and/or modulation of gene expression of UNC13A. Dual targeting antisense oligonucleotides comprising a first antisense sequence targeting a first target region and a second antisense sequence targeting a second target region allow for effective splicing modulation of an UNC13A cryptic exon while reducing off-target risks. In some embodiments, the UNC13A RNA transcript may be within a cell, e.g., a cell within a subject, such as a human subject. Compositions comprising such antisense oligonucleotides and methods of using such (e.g., for treating an UNC13A-associated disease, such as ALS or FTD) are also provided.

Some aspects of the present disclosure provide antisense oligonucleotides comprising a first antisense sequence targeting a first target region and a second antisense sequence targeting a second target region, wherein the first target region and/or the second target region each comprises an UNC13A sequence, wherein the antisense oligonucleotide modulates splicing of an UNC13A cryptic exon. In some embodiments, the first target region or the second target region comprises a nucleotide sequence as set forth in SEQ ID NO: 313 or SEQ ID NO: 315. In some embodiments, the UNC13A cryptic exon is in intron 20 of an UNC13A pre-mRNA.

In some embodiments, the first target region and the second target region are in intron 20 of an UNC13A pre-mRNA. In some embodiments, the first target region is adjacent to the second target region in an UNC13A pre-mRNA. In some embodiments, the first target region is downstream of the second target region in an UNC13A pre-mRNA. In some embodiments, the first target region is more than 1 nucleoside downstream of the second target region. In some embodiments, the first target region is downstream of the cryptic exon and the second target region is in the cryptic exon.

In some embodiments, the first target region comprises a nucleotide sequence as set forth in SEQ ID NO: 315 and/or the second target region comprises a nucleotide sequence as set forth in SEQ ID NO: 313. In some embodiments, the first target region comprises the nucleotide sequence of SEQ ID NO: 315, and the second target region comprises the nucleotide sequence of SEQ ID NO: 313.

In some embodiments, the first antisense sequence and/or the second antisense sequence is 6-15 nucleosides in length. In some embodiments, the first antisense sequence and the second antisense sequence is 6-15 nucleosides in length. In some embodiments, the first antisense sequence and/or the second antisense sequence is 8-15 nucleosides in length. In some embodiments, the first antisense sequence comprises at least 6 contiguous nucleobases of any one of SEQ ID NOs: 191-247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC, and/or wherein the second antisense sequence comprises at least 6 contiguous nucleobases of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA. In some embodiments, the first antisense sequence comprises at least 7 contiguous nucleobases of any one of SEQ ID NOs: 191-247, 274, 288, 495-515, AGCCACGA, ACGAATC, CGAATCT, GAATCTA, AATCTAC, CAATCAT, GTTCAAT, TTCAATC, TCAATCA, TTT- TATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC, and/or wherein the second antisense sequence comprises at least 7 contiguous nucleobases of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA. In some embodiments, the first antisense sequence comprises at least 8 contiguous nucleobases of any one of SEQ ID NOS: 191-247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC, and/or wherein the second antisense sequence comprises at least 8 contiguous nucleobases of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA. In some embodiments, the first antisense sequence comprises the nucleobase sequence of any one of SEQ ID NOs: 191-247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC, and/or wherein the second antisense sequence comprises the nucleobase sequence of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA.

In some embodiments, the first antisense sequence and the second antisense sequence are immediately adjacent to each other. In some embodiments, one or more nucleobases are between the first antisense sequence and the second antisense sequence. In some embodiments, one or more (e.g., 1, 2, 3, 4, 5, or more) nucleobases at the 3' end of the first antisense sequence is complementary to one or more (e.g., 1, 2, 3, 4, 5, or more) nucleobases at the 3' end of the second target region, and/or one or more (e.g., 1, 2, 3, 4, 5, or more) nucleobases at the 5' end of the second antisense sequence is complementary to one or more (e.g., 1, 2, 3, 4, 5, or more) nucleobases at the 5' end of the first target region. In some embodiments, a spacer is between the first antisense sequence and the second antisense sequence. In some embodiments, the spacer is a C3 spacer (e.g., a C3 spacer shown in Table 16). In some embodiments, the spacer is a C6 spacer (e.g., a C6 spacer shown in Table 16).

In some embodiments, an antisense oligonucleotide provided herein comprises a first antisense sequence comprising the nucleobase sequence of SEQ ID NO: 194 and a second antisense sequence comprising the nucleobase sequence of SEQ ID NO: 253, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of SEQ ID NO: 194 and a second antisense sequence comprising the nucleobase sequence of SEQ ID NO: 253, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of SEQ ID NO: 497 and a second antisense sequence comprising the nucleobase sequence of SEQ ID NO: 249, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of SEQ ID NO: 506 and a second antisense sequence comprising the nucleobase sequence of SEQ ID NO: 259, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of SEQ ID NO: 246 and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of SEQ ID NO: 198 and a second antisense sequence comprising the nucleobase sequence of SEQ ID NO: 253, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of GAATCTA and a second antisense sequence comprising the nucleobase sequence of SEQ ID NO: 246, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTA and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of GAATCTA and a second antisense sequence comprising the nucleobase sequence of SEQ ID NO: 534, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTA and a second antisense sequence comprising the nucleobase sequence of SEQ ID NO: 534, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of GAATCTACC and a second antisense sequence comprising the nucleobase sequence of SEQ ID NO: 535, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTACC and a second antisense sequence comprising the nucleobase sequence of SEQ ID NO: 535, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of GAATCTACC and a second antisense sequence comprising the nucleobase sequence of SEQ ID NO: 264, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTACC and a second antisense sequence comprising the nucleobase sequence of SEQ ID NO: 264, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a first antisense sequence comprising the nucleobase sequence of GAATCTAC and a second antisense sequence comprising the nucleobase sequence of SEQ ID NO: 264, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTAC and a second antisense sequence comprising the nucleobase sequence of SEQ ID NO: 246, wherein the 3' end of the first antisense sequence is linked to the 5' end of the second antisense sequence by a C3 spacer (e.g., a C3 spacer, as shown in Table 16).

In some embodiments, an antisense oligonucleotide provided herein comprises a first antisense sequence comprising the nucleobase sequence of GAATCTAC and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, an antisense oligonucleotide provided herein comprises a nucleobase sequence of any one of SEQ ID NOs: 1-190 and 338-494. In some embodiments, an antisense oligonucleotide provided herein comprises a nucleobase sequence of any one of SEQ ID NOS: 1-182, 184-190, 338-434, 442-494.

In some embodiments, an antisense oligonucleotide provided herein comprises one or more modified nucleosides. In some embodiments, the one or more modified nucleosides comprise a non-bicyclic 2'-modified nucleoside, a 2'-4' bridged nucleoside, or combinations thereof. In some embodiments, each nucleoside of the antisense oligonucleotide is a modified nucleoside.

In some embodiments, the non-bicyclic 2'-modified nucleoside is a 2'-O-methoxyethyl (2'-MOE) modified nucleoside, a 2'-O—N-methylacetamide (2'-O-NMA) modified nucleoside, a 2'-O-Methyl (2'-O-Me) modified nucleoside, or a 2'-fluoro (2'-F) modified nucleoside, and/or the 2'-4' bridged nucleoside is a locked nucleic acid (LNA, 2'-4' methylene bridge), an ethylene-bridged nucleic acid (ENA, 2'-4' ethylene bridge), a constrained ethyl nucleic acid (cEt, 2'-4' ethylene bridge), a 2'-O, 4'-C-Spirocyclopropylene bridged nucleic acid (scpBNA), an amido-bridged nucleic acid (AmNA), or a 2'-O, 4'-C-aminomethylene bridged nucleic acid (BNA (NC)). In some embodiments, the antisense oligonucleotide comprises one or more 2'-MOE modified nucleosides and one or more LNAs. In some embodiments, each nucleoside of the antisense oligonucleotide is a 2'-MOE modified nucleoside. In some embodiments, the antisense oligonucleotide comprises one or more modified nucleosides selected from ENA, scpBNA. 2'-O-NMA, AmNA, and BNA (NC). In some embodiments, each nucleoside of the antisense oligonucleotide is a modified nucleoside, wherein the antisense oligonucleotide comprises one or more modified nucleosides selected from ENA, scpBNA, 2'-O-NMA, AmNA, and BNA (NC), and wherein the remaining modified nucleosides are 2'-MOE modified nucleosides, LNAs, or a mix of 2'MOE modified nucleosides and LNAs.

In some embodiments, an antisense oligonucleotide provided herein comprises one or more modified internucleoside linkages. In some embodiments, each internucleoside linkage of the oligonucleotide is a modified internucleoside linkage. In some embodiments, the modified internucleoside linkage is a phosphorothioate linkage. In some embodiments, each internucleoside linkage of the oligonucleotide is a phosphorothioate linkage. In some embodiments, the antisense oligonucleotide comprises a mix of phosphodiester linkages and phosphorothioate linkages.

In some embodiments, the antisense oligonucleotide is a phosphorodiamidate oligomer (PMO).

In some embodiments, each cytosine of the oligonucleotide is not a 5-methyl-cytosine. In some embodiments, each cytosine of the oligonucleotide is a 5-methyl-cytosine. In some embodiments, one or more of the cytosines of the oligonucleotide is a 5-methyl-cytosine.

In some embodiments, the antisense oligonucleotide is linked to a lipid. In some embodiments, the lipid is a C16 lipid. In some embodiments, the C16 lipid is linked the 5' nucleoside of the antisense stand via a DNA linker. In some embodiments, the DNA linker is a phosphodiester d (TCA) linker, wherein each internucleoside linkage is a phosphodiester linkage.

In some embodiments, an antisense oligonucleotide provided herein comprises a structure as provided in Table 5. In some embodiments, an antisense oligonucleotide provided herein comprises a structure as provided in Table 11. In some embodiments, an antisense oligonucleotide provided herein comprises a structure of any one of ASOs 1-331 or 350-814. In some embodiments, an antisense oligonucleotide provided herein comprises a structure of any one of SEQ ID NOs: 569-925, 927-957, 960-970, 973-1039, 1042-1165, 1170-1350, and 1355-1362. In some embodiments, an antisense oligonucleotide provided herein comprises a structure of any one of ASOs 407, 408, 420, 488, 613, 614, and 796-806. In some embodiments, an antisense oligonucleotide provided herein comprises a structure of any one of SEQ ID NOs: 569-880, 882-925, 927-957, 960-970, 973-

1039, 1042-1155, 1165, 1170-1350, 1355-1362 and ASOs 407, 408, 420, 488, 613, 614, and 796-806. In some embodiments, the antisense oligonucleotide inhibits inclusion of the UNC13A cryptic exon into an UNC13A mature mRNA. In some embodiments, the antisense oligonucleotide induces a secondary structure between the first target region and the second target region in the UNC13A pre-mRNA.

In some embodiments, the antisense oligonucleotide comprises the following structure: [iTs][iGs][iTs][iTs][i$^5$Cs][iAs][iAs][iTs][i$^5$Cs][iAs][iTs][iTs][i$^5$Cs][iGs][iGs][iGs][iAs][iTs][i As][iAs][iG][iA][iG][iT][iTs][i$^5$C] (SEQ ID NO: 569), wherein iA, iG, i$^5$C, and iT are 2'-O-methoxyethyl (2'-MOE) modified adenosine, guanosine, 5'-methyl cytidine, and thymidine, respectively; s is a phosphorothioate internucleoside linkage; and the absence of s between two nucleosides indicate a phosphodiester internucleoside linkage.

In some embodiments, the antisense oligonucleotide comprises the following structure: [iT][iGs][iTS][iTs][i$^5$Cs][iAs][iAs][iTs][i$^5$Cs][iAs][iTs][iTs][i$^5$Cs][iGs][iGs][iGs][iAs][iTs][i As][iAs][iGs][iA][iG][iT][iTs][i$^5$C] (SEQ ID NO: 570), wherein iA, iG, i$^5$C, and iT are 2'-O-methoxyethyl (2'-MOE) modified adenosine, guanosine, 5'-methyl cytidine, and thymidine, respectively: s is a phosphorothioate internucleoside linkage; and the absence of s between two nucleosides indicate a phosphodiester internucleoside linkage.

In some embodiments, the antisense oligonucleotide comprises the following structure: [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTS][iTs][i$^5$Cs][iAs][iAs][iTs][i$^5$Cs][iA] (SEQ ID NO: 571), wherein iA, iG, i$^5$C, and iT are 2'-O-methoxyethyl (2'-MOE) modified adenosine, guanosine, 5'-methyl cytidine, and thymidine, respectively; and s is a phosphorothioate internucleoside linkage.

In some embodiments, the antisense oligonucleotide comprises the following structure: [iTS][iG][iT][iTs][i$^5$Cs][iAs][iAs][iTs][i$^5$Cs][iAs][iTs][iTs][i$^5$Cs][iGs][iGs][iGs][iAs][iTs][iAs][iAs][iGs][iAs][iG][iT][iTs][i$^5$C] (SEQ ID NO: 572), wherein iA, iG, i$^5$C, and iT are 2'-O-methoxyethyl (2'-MOE) modified adenosine, guanosine, 5'-methyl cytidine, and thymidine, respectively; s is a phosphorothioate internucleoside linkage; and the absence of s between two nucleosides indicate a phosphodiester internucleoside linkage.

In some embodiments, the antisense oligonucleotide comprises the following structure: [iTS][iG][iT][iT][i$^5$Cs][iAs][iAs][iTs][i$^5$Cs][iAs][iTs][iTs][i$^5$Cs][iGs][iGs][iGs][iAs][iTs][iAs][iAs][iGs][iA][iG][iT][iTs][i$^5$C] (SEQ ID NO: 573), wherein iA, iG, i$^5$C, and iT are 2'-O-methoxyethyl (2'-MOE) modified adenosine, guanosine, 5'-methyl cytidine, and thymidine, respectively; s is a phosphorothioate internucleoside linkage; and the absence of s between two nucleosides indicate a phosphodiester internucleoside linkage.

In some embodiments, the antisense oligonucleotide comprises the following structure: [nmaTs][nmaGs][nmaTs][nmaTs][nma$^5$Cs][nmaAs][nmaAs][nmaTs][nma$^5$Cs][nmaAs][nmaTs][nmaTs][nma$^5$Cs][nmaGs][nmaGs][nmaGs][nmaAs][nmaTs][nmaAs][nmaA][nmaG][nmaA][nmaG][nmaT][nmaTs][nma$^5$C] (SEQ ID NO: 969), wherein nmaA, nmaG, nma C, and nmaT are 2'O-NMA modified adenosine, guanosine, 5'-methyl cytidine, and thymidine, respectively; s is a phosphorothioate internucleoside linkage; and the absence of s between two nucleosides indicate a phosphodiester internucleoside linkage.

In some embodiments, the antisense oligonucleotide comprises the following structure: [nma$^5$Cs][nmaGs][nmaAs][nmaAs][nmaTs][nma$^5$Cs][nmaTs][nmaAs][nma$^5$Cs][nma$^5$Cs][nma$^5$Cs][nmaAs][nma$^5$Cs][nmaAs][nmaTs][nma$^5$Cs][nmaTs][nmaGs][nmaTs][nmaTs][nma$^5$Cs][nmaAs][nmaAs][nmaTs][nma$^5$Cs][nmaA] (SEQ ID NO: 1115), wherein nmaA, nmaG, nma$^5$C, and nmaT are 2'O-NMA modified adenosine, guanosine, 5'-methyl cytidine, and thymidine, respectively; and s is a phosphorothioate internucleoside linkage.

In some embodiments, the antisense oligonucleotide comprises the following structure: [nmaAs][nma$^5$Cs][nmaGs][nmaAs][nmaAs][nmaTs][nma$^5$Cs][nmaTs][nmaAs][nma$^5$Cs][nma$^5$Cs][nma$^5$Cs][nmaAs][nma$^5$Cs][nmaAs][nmaTs][nma$^5$Cs][nmaTs][nmaGs][nmaTs][nmaTs][nma$^5$Cs][nmaAs][nmaAs][nmaTs][nma$^5$C] (SEQ ID NO: 1116), wherein nmaA, nmaG, nma° C., and nmaT are 2'O-NMA modified adenosine, guanosine, 5'-methyl cytidine, and thymidine, respectively; and s is a phosphorothioate internucleoside linkage.

In some embodiments, the antisense oligonucleotide comprises the following structure: [IGs][nmaAs][nmaAs][nmaTs][nma$^5$Cs][nmaTs][nmaAs][nma$^5$Cs][nma$^5$Cs][nmaAs][nmaTs][nma$^5$Cs][nma$^5$Cs][nmaAs][nmaTs][nmaGs][nmaTs][nmaAs][nma$^5$Cs][iT] (SEQ ID NO: 1355), wherein IA, IG, I$^5$C, and IT are 2'-4' methylene bridge (LNA) modified adenosine, guanosine, 5'-methyl cytidine, and thymidine, respectively; nmaA, nmaG, nma$^5$C, and nmaT are 2'O-NMA modified adenosine, guanosine, 5'-methyl cytidine, and thymidine, respectively; and s is a phosphorothioate internucleoside linkage.

In some embodiments, the antisense oligonucleotide comprises the following structure: [IGs][nmaAs][nmaAs][nmaTs][nma$^5$Cs][nmaTs][nmaAs][nma$^5$Cs][nma$^5$Cs][nma$^5$Cs][nmaAs][nmaTs] [nma$^5$Cs][nma$^5$Cs][nmaAs][nmaTs][nmaGs][nmaTs][nmaAs][nmasCs][iT] (SEQ ID NO: 1356), wherein IA, IG, I$^5$C, and IT are 2'-4' methylene bridge (LNA) modified adenosine, guanosine, 5'-methyl cytidine, and thymidine, respectively; nmaA, nmaG, nma$^5$C, and nmaT are 2'O-NMA modified adenosine, guanosine, 5'-methyl cytidine, and thymidine, respectively; and s is a phosphorothioate internucleoside linkage.

In some embodiments, the antisense oligonucleotide is in the form of a pharmaceutically acceptable salt.

Some aspects of the present disclosure provide compositions comprising an antisense oligonucleotide provided herein. In some embodiments, a composition provided herein further comprises a pharmaceutically acceptable carrier.

Some aspects of the present disclosure provide methods of inhibiting inclusion of an UNC13A cryptic exon into an UNC13A mature mRNA and/or restoring UNC13A expression in a cell, comprising contacting the cell with an antisense oligonucleotide or composition provided herein.

Some aspects of the present disclosure provide methods of inhibiting inclusion of an UNC13A cryptic exon into an UNC13A mature mRNA and/or restoring UNC13A expression in a cell of a subject, comprising administering to the subject an antisense oligonucleotide or composition provided herein. In some embodiments, the method comprises administering to the subject a therapeutically effective amount of an antisense oligonucleotide or composition provided herein. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject is human. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide methods of treating a disease associated with abnormal UNC13A expression in a subject, comprising administering to the subject an antisense oligonucleotide or composition provided herein. In some embodiments, the method comprises administering to the subject a therapeutically effective amount of an antisense oligonucleotide or composition provided herein. In some embodiments, the disease is a neurodegenerative disease. In some embodiments, the neurodegenerative disease is amyotrophic lateral sclerosis (ALS). In some embodiments, the neurodegenerative disease is frontotemporal dementia (FTD). In some embodiments, the neurodegenerative disease is Alzheimer's disease. In some embodiments, the neurodegenerative disease is Limbic-Predominant Age-Related TDP-43 Encephalopathy (LATE). In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide methods of treating a disease associated with TDP-43 dysfunction in a subject, comprising administering to the subject an antisense oligonucleotide or composition provided herein. In some embodiments, the method comprises administering to the subject a therapeutically effective amount of an antisense oligonucleotide or composition provided herein. In some embodiments, the disease is a neurodegenerative disease. In some embodiments, the neurodegenerative disease is amyotrophic lateral sclerosis (ALS). In some embodiments, the neurodegenerative disease is frontotemporal dementia (FTD). In some embodiments, the neurodegenerative disease is Alzheimer's disease. In some embodiments, the neurodegenerative disease is Limbic-Predominant Age-Related TDP-43 Encephalopathy (LATE). In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide pharmaceutical compositions for use in a method of inhibiting inclusion of an UNC13A cryptic exon into an UNC13A mature mRNA and/or restoring UNC13A expression in a cell of a subject comprising the antisense oligonucleotide provided herein. In some embodiments, the pharmaceutical composition comprises a therapeutically effective amount of an antisense oligonucleotide provided herein. In some embodiments, the pharmaceutical composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide pharmaceutical compositions for use in a method of treating a disease associated with abnormal UNC13A expression in a subject comprising the antisense oligonucleotide provided herein. In some embodiments, the pharmaceutical composition comprises a therapeutically effective amount of the antisense oligonucleotide provided herein. In some embodiments, the pharmaceutical composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide pharmaceutical compositions for use in a method of treating a disease associated with TDP-43 dysfunction in a subject comprising the antisense oligonucleotide provided herein. In some embodiments, the pharmaceutical composition comprises a therapeutically effective amount of the antisense oligonucleotide provided herein. In some embodiments, the pharmaceutical composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide antisense oligonucleotides for use in a method of inhibiting inclusion of an UNC13A cryptic exon into an UNC13A mature mRNA and/or restoring UNC13A expression in a cell of a subject, the method comprising administering to the subject an antisense oligonucleotide provided herein. In some embodiments, the method comprises administering to the subject an effective amount of an antisense oligonucleotide provided herein. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide antisense oligonucleotides for use as a medicament. In some embodiments, the medicament is administered to a subject. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide antisense oligonucleotides for use in a method of treating a disease associated with abnormal UNC13A expression in a subject, the method comprising administering to the subject an antisense oligonucleotide provided herein. In some embodiments, the method comprises administering to the subject an effective amount of an antisense oligonucleotide provided herein. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide antisense oligonucleotides for use in a method of treating a disease associated with TDP-43 dysfunction in a subject, the method comprising administering to the subject an antisense oligonucleotide provided herein. In some embodiments, the method comprises administering to the subject an effective amount of an antisense oligonucleotide provided herein. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide a use of an antisense oligonucleotide provided herein for the manufacture of a medicament for inhibiting inclusion of an UNC13A cryptic exon into an UNC13A mature mRNA and/or restoring UNC13A expression in a cell of a subject. In some embodiments, the composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide a use of an antisense oligonucleotide provided herein for the manufacture of a medicament for treating a disease associated with abnormal UNC13A expression in a subject. In some embodiments, the composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

Some aspects of the present disclosure provide a use of an antisense oligonucleotide provided herein for the manufacture of a medicament for treating a disease associated with TDP-43 dysfunction in a subject. In some embodiments, the composition further comprises a pharmaceutically acceptable carrier. In some embodiments, the subject is human. In some embodiments, the subject has decreased expression of TDP-43 gene or protein. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

DETAILED DESCRIPTION

Generally, nomenclatures used in connection with cell and tissue culture, molecular biology, immunology, microbiology, genetics and protein and nucleic acid chemistry and hybridization described herein are those well-known and commonly used in the art. Certain methods and techniques provided herein are generally performed according to methods well-known in the art and as described in various general and more specific references that are cited and discussed throughout the present specification unless otherwise indicated. Enzymatic reactions and purification techniques are performed according to manufacturer's specifications, as commonly accomplished in the art or as otherwise described herein. The nomenclatures, laboratory procedures and techniques of analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, delivery, and treatment of patients.

Any of the methods for gene therapy available in the art can be used in the methods provided herein. For general reviews of the methods of gene therapy, see Goldspiel et al. (1993) Clin. Pharmacy 12:488-505; Wu and Wu (1991) Biotherapy 3:87-95; Tolstoshev (1993) Ann. Rev. Pharmacol. Toxicol. 32:573-596; Mulligan (1993) Science 260:926-932; Morgan and Anderson (1993) Ann. Rev. Biochem. 62:191-217; and May (1993) TIBTECH 11 (5): 155-215. Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed description of various methods of gene therapy are disclosed in US Patent Publication No. US20050042664.

Definitions

In order that the present disclosure may be more readily understood, certain terms are first defined. Unless otherwise defined herein, scientific and technical terms used in connection with the present disclosure shall have the meanings that are commonly understood by those of ordinary skill in the art. The meaning and scope of the terms should be clear, however, in the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including", as well as other forms of the term, is not limiting.

In addition, it should be noted that whenever a value or range of values of a parameter are recited, it is intended that values and ranges intermediate to the recited values are also part of this disclosure.

As used herein, the singular forms "a", "an" and "the" include plural referents unless the context clearly dictates otherwise. "And" as used herein is interchangeably used with "or" unless expressly stated otherwise. The terms "comprising, "having." "including," and "containing" are to be construed as open-ended terms (i.e., meaning "including, but not limited to") unless otherwise noted. Recitation of ranges of values herein are merely intended to serve as a shorthand method of referring individually to each separate value recited or falling within the range, unless otherwise indicated herein, and each separate value is incorporated into the specification as if it were individually recited.

The term "about" or "approximately." as applied to one or more values provided herein, refers to a value that is similar to a stated reference value. In some embodiments, the term "about" or "approximately" refers to a range of values that fall within and include 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context. In some embodiments, "about" or "approximately" can be understood as about 2 standard deviations from the mean. In some embodiments, "about" or "approximately" means up to and including ±10% (e.g., ±10%, ±9%, ±8%. ±7%, ±6%, ±5%. ±4%, ±3%, ±2%, ±1%, or less). In some embodiments, "about" or "approximately" means±5%. When "about" or "approximately" is present before a series of numbers or a range, it is understood that it can modify each of the numbers in the series or range.

The term "administering" or "administration of," as used herein, means to provide an agent, e.g., antisense oligonucleotide to a subject. In some embodiments, "administering" or "administration of" means to provide an antisense oligonucleotide to a subject in a manner that is physiologically and/or pharmacologically useful (e.g., to treat a condition in the subject). Non-limiting examples of routes of administration include intravenous, intramuscular, intraperitoneal, intracerebrospinal, subcutaneous, intra-articular, intrasynovial, intrathecal routes, or intracerebroventricular routes. In some embodiments, the route of administration is intrathecal, or intracerebroventricular routes. In some embodiments, the route of administration is intrathecal. In some embodiments, the route of administration is intracerebroventricular. In some embodiments, the route of administration is subcutaneous.

The term "antisense oligonucleotide (ASO)," as used herein, refers to a single-stranded oligonucleotide which comprises one or more (e.g., 1, 2, or more) regions of complementarity each capable of hybridizing with at least a part, for example, a target region of a target sequence (e.g., gene sequence, pre-mRNA sequence, or mRNA sequence), and which can modulate the processing of the transcription product of a target gene and/or the expression (e.g., mRNA and/or protein level) of the target gene. In some embodiments, a target region of a target nucleotide sequence can have a length of at least 8 nucleosides, for example, a length of 8, 9, 10, 11, 12, 13, 14, 15, or more nucleosides.

In some embodiments, an antisense oligonucleotide disclosed herein modulates splicing of an UNC13A pre-mRNA. In some embodiments, an antisense oligonucleotide disclosed herein modulates splicing of an UNC13A cryptic exon present in the UNC13A pre-mRNA (e.g., a cryptic exon in intron 20 of an UNC13A pre-mRNA). In some embodiments, splicing modulation of UNC13A pre-mRNA and/or an UNC13A cryptic exon present in the UNC13A pre-mRNA results in modulation of UNC13A gene expression (e.g., mRNA and/or protein level).

In some embodiments, an antisense oligonucleotide disclosed herein targets two target regions of a target sequence (e.g., gene sequence, pre-mRNA sequence, or mRNA sequence). In some embodiments, an antisense oligonucleotide disclosed herein targets two target regions of an UNC13A sequence (e.g., gene sequence or pre-mRNA sequence). In some embodiments, the two target regions of an UNC13A sequence (e.g., gene sequence or pre-mRNA sequence) have 0-200 nucleobases (e.g., 0-200, 0-150, 0-100, 0-50, 0-20, 0-10, 0-5, 5-200, 5-150, 5-100, 5-50, 5-20, 5-10, 10-200, 10-150, 10-100, 10-50, 10-20, 20-200, 20-150, 20-100, 20-50, 50-200, 50-150, 50-100, 100-200, 100-150, or 150-200 nucleobases) in between.

In some embodiments, an antisense oligonucleotide comprises a first antisense sequence and a second antisense sequence, each targeting one of the two target regions of a target sequence (e.g., gene sequence, pre-mRNA sequence, or mRNA sequence). In some embodiments, an antisense oligonucleotide comprises a first antisense sequence and a second antisense sequence, each targeting one of the two target regions of an UNC13A sequence (e.g., gene sequence or pre-mRNA sequence). In some embodiments, the first antisense sequence is immediately adjacent to the second antisense sequence (i.e., having no nucleobases in between). In some embodiments, one or more (e.g., 1, 2, 3, 4, 5, 6, 7, 8, 9, 10, 11, 12, 13, 14, 15, 16, 17, 18, 19, 20 or more) nucleobases are between the first antisense sequence and the second antisense sequence.

For the purposes of this disclosure, in an antisense oligonucleotide disclosed herein, the first antisense sequence is at the 5' end of the antisense oligonucleotide and the second antisense sequence is at the 3' end of the antisense oligonucleotide. Further, in an antisense oligonucleotide disclosed herein, the first antisense sequence targets the first target region of a target sequence (e.g., UNC13A pre-mRNA) and the second antisense sequence targets the second target region of a target sequence (e.g., UNC13A pre-mRNA). As such, the first target region is 3' to the second target region in the target sequence (e.g., UNC13A pre-mRNA), and the second target region is 5' to the first target region in the target sequence (e.g., UNC13A pre-mRNA).

The term "at least" prior to a number or series of numbers is understood to include the number adjacent to the term "at least", and all subsequent numbers or integers that could logically be included, as clear from context. For example, the number of nucleotides or nucleosides in a nucleic acid molecule must be an integer. For example, "at least 19 nucleosides of a 21-nucleotide nucleic acid molecule" means that 19, 20, or 21 nucleosides have the indicated property. When at least is present before a series of numbers or a range, it is understood that "at least" can modify each of the numbers in the series or range.

The term "Amyotrophic lateral sclerosis (ALS)" or "ALS." as used herein, refers to a neurodegenerative disease characterized by progressive upper and lower motor neuron loss. Two types of the disease, sporadic ALS (sALS) and familial ALS (fALS) have been described. sALS is the most common form of ALS, accounting for around 90% of all ALS cases, while fALS is rarer and genetic, as it occurs in a series of generations in families. Both forms of ALS show rapid clinical deterioration after onset of the disease, leading to death within a few years often due to respiratory failure. The exact cause of ALS is unknown and there is no known cure.

The term "frontotemporal dementia" or "FTD." as used herein, refers to a progressive neurodegenerative disease of humans which has been found to have significant overlap with ALS at clinical, genetic, and pathologic levels. Burrell J R. Halliday G M, Kril J J, et al. The frontotemporal dementia-motor neuron disease continuum. Lancet. 2016; 388 (10047): 919-931. FTD is characterized by damage to neurons in the frontal and temporal lobes of the brain. Three types of the disease, behavioral variant frontotemporal dementia (bvFTD), primary progressive aphasia (PPA), and movement disorders, have been described, with bvFTD being the most common and involving changes in personality, behavior, and judgment. Some patients suffer from both Frontotemporal Dementia and ALS. Thus, these diseases are on one molecular and clinical spectrum. The exact cause of FTD is unknown and there is no known cure.

While causes of ALS and FTD are generally unknown, single nucleotide polymorphisms (SNPs), e.g., intronic SNPs, in UNC13A have been shown to increase the risk of ALS and FTD. In some instances, the SNPs increase cryptic splicing and alter direct binding of RNA-binding protein TDP-43, which reduces the ability of TDP-43 to repress cryptic exon inclusion in UNC13A during RNA splicing. TDP-43 dysfunction has been shown to result in inclusion of a cryptic exon in an UNC13A mRNA. Cryptic exon inclusion in an UNC13A mature mRNA results in reduced UNC13A protein expression due to aberrant RNA degradation or the presence of premature stop codons. In some embodiments, antisense oligonucleotides disclosed herein inhibit inclusion of an UNC13A cryptic exon into an UNC13A mature mRNA and/or restore UNC13A expression in a cell in a subject with ALS or FTD.

The term "Alzheimer's disease." as used herein is a progressive degenerative brain disease and the most common form of dementia. Alzheimer's disease is associated with the abnormal accumulation of amyloid-β (AB) plaques and neurofibrillary tangles of tau protein aggregates. Alzheimer's disease is characterized by a progressive pattern of cognitive and functional impairment. TDP-43 pathology also plays a role in the progression of Alzheimer's disease. Meneses et al., TDP-43 Pathology in Alzheimer's Disease. Mol Neurodegener. 2021 Dec. 20; 16 (1): 84. There is currently no known cure for Alzheimer's disease.

The term "Limbic-Predominant Age-Related TDP-43 Encephalopathy" or "LATE," as used herein is a late-onset neurogenerative disease characterized by amnestic dementia resembling Alzheimer's disease dementia. LATE typically affects persons 80 years of age or older. LATE is characterized by TDP-43 inclusions predominated in the limbic regions of the brain, including the amygdala and hippocampus. Nelson et al., Limbic-predominant age-related TDP-43 encephalopathy (LATE): consensus working group report, Brain, Volume 142, Issue 6, June 2019, Pages 1503-1527. There is currently no known cure for LATE.

The term "biological activity" means any biological property of a molecule, whether present naturally in vivo, or provided or enabled by recombinant means. Biological activities include, but are not limited to, binding to a receptor, inducing cell proliferation, inhibiting cell growth, inducing other cytokines, inducing apoptosis, and enzymatic activity.

The term "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

The term "complementary." as used herein, refers to the capacity for base pairing between two nucleobases or two nucleobase sequences. In particular, complementary is a term that characterizes an extent of hydrogen bond pairing that brings about binding between two nucleobases or two nucleobase sequences. For example, if a base at one position of a nucleobase sequence (e.g., of an antisense oligonucleotide described herein) is capable of hydrogen bonding with a base at the corresponding position of another nucleobase sequence (e.g., target gene sequence, pre-mRNA sequence, or mRNA sequence), then the bases are considered to be complementary to each other at that position. The nucleic acid molecules (e.g., antisense oligonucleotide) whose nucleobase sequence is complementary may comprise one or more modified nucleosides and modified internucleoside linkages. The nucleic acid molecules (e.g., antisense oligonucleotide and target sequence) whose nucleobase sequence is complementary may also comprise nucleobase analogous that result in bases at certain positions not being complementary, but the nucleobase sequences of the two molecules must be sufficiently complementary over the entire length to result in a desired biological activity (e.g., modulation of gene expression).

Complementary sequences include Watson-Crick base pairs or non-Watson-Crick base pairs (e.g., Wobble base pairs (e.g., G-U/T, A-G) and Hoogsteen base pairs) and may include natural or modified nucleosides or nucleoside mimics. For example, in some embodiments, for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A. C. U. or T. Inosine (I) has also been considered in the art to be a universal base and is considered complementary to any A, C. U or T.

Complementarity is independent of modifications in the sugar of a nucleoside. For example, 2'-modified A, as defined herein, are complementary to U (or T) and identical to A for the purposes of determining identity or complementarity.

The term "perfectly complementary" or "fully complementary" means that all (100%) of the nucleobases, nucleosides, or nucleotides in a contiguous sequence of a first nucleotide sequence (e.g., an antisense oligonucleotide) will hybridize with the same number of nucleobases, nucleosides, or nucleotides in a contiguous sequence of second nucleotide sequence (e.g., a target sequence such as an UNC13A pre-mRNA). The contiguous sequence may comprise all or a part of a first or second nucleotide sequence. The term "partially complementary" means that in a hybridized pair of nucleobase, nucleosides, or nucleotide sequences, at least 70%, but not all, of the bases in a contiguous sequence of a first nucleotide sequence (e.g., an antisense oligonucleotide) will hybridize with the same number of bases in a contiguous sequence of a second nucleotide sequence (e.g., a target sequence such as an UNC13A pre-mRNA). The term "sufficiently complementary" or "substantially complementary" means that in a hybridized pair of nucleobase, nucleosides, or nucleotide sequences, at least 85%, but not all, of the bases in a contiguous sequence of a first nucleotide sequence (e.g., an antisense oligonucleotide) will hybridize with the same number of bases in a contiguous sequence of a second nucleotide sequence (e.g., a target sequence such as an UNC13A pre-mRNA). The terms "complementary," "fully complementary," "partially complementary," and "sufficiently/substantially complementary" herein are used with respect to the nucleobase, nucleosides, or nucleotide matching between an antisense oligonucleotide and a target sequence (e.g., an UNC13A pre-mRNA).

The term "control" or "reference," when referring to a substance, means a composition used as a standard or a point of comparison against which other test results are measured. In some embodiments, a "control" or "reference" is a composition known to not contain analyte ("negative control") or to contain analyte ("positive control"). A positive control can comprise a known concentration of analyte. "Control," and "positive control," may be used to refer to a composition comprising a known concentration of analyte. A "positive control" can be used to establish assay performance characteristics and is a useful indicator of the integrity of reagents (e.g., analytes). In some embodiments, an appropriate "control" or "reference" is where only one element is changed in order to determine the effect of the one element. In some embodiments, a control is a level of a target gene (e.g., in a cell or in a subject) before treatment (e.g., with an antisense oligonucleotide described herein).

The term "control" or "reference" also means a baseline level of a measurement depending upon the context, in which the term is used. A baseline level of a measurement is a standard or a point of comparison against which the measurement is compared. In some embodiments, a "control" or a "reference" refers to a level of a measurement for certain biological activity or substance in a cell, a tissue, an organ, or a subject, e.g., the expression level of a gene, copy number of mRNA for such gene, or level of protein encoded by such gene, without treatment of the cell, the tissue, the organ, or the subject, with an agent, e.g., antisense oligonucleotide. In some embodiments, a "control" or a "reference" refers to a level of an average measurement for a certain biological activity or substance in a cell, a tissue, an organ, or a subject, e.g., certain enzyme activity of the liver, among a group of healthy subjects, e.g., the general population within in certain geographic or demographic limits or any other limits that may be appropriate for the study of certain disease or disorder, that does not have certain disease or disorder, e.g., liver disease.

The term "reference" may also be used in "reference sequence." The term "reference sequence" refers to a sequence, e.g., a nucleic acid sequence or an amino acid sequence, used as a basis for sequence comparison. In certain embodiments, a reference sequence is an RNA sequence, e.g., human UNC13A pre-mRNA sequence, upon which the design of the antisense oligonucleotide is based.

The term "cross-reactive" means the ability of a binding molecule (e.g., an antisense oligonucleotide) to bind a target molecule (e.g., gene sequence, pre-mRNA sequence, or mRNA sequence) other than that against which it was designed or generated. For example, the binding molecule is capable of specifically binding to more than one target molecule of a similar type or class (e.g., mRNA variants or mRNA homologous from closely related species) with similar affinity. Generally, a binding molecule will bind its target molecule with an appropriately high affinity but can bind to the same target molecule of another species or display a low affinity for non-target molecules. In some embodiments, an antisense oligonucleotide that is cross-reactive against human and non-human primate UNC13A comprises a region of complementarity to human and non-human primate UNC13A gene sequence, pre-mRNA sequence, or mRNA sequence. Individual binding molecules are generally selected to meet two criteria: (1) tissue staining appropriate for the known expression of the target or (2) similar staining pattern between human and toxicology species (mouse and cynomolgus monkey) tissues from the same organ. These and other methods of assessing cross-reactivity are known to one skilled in the art.

The term "effective amount" or "therapeutically effective amount," as used herein, refers to that amount of an antisense oligonucleotide to produce a molecular (e.g., reducing inclusion of an UNC13A cryptic exon into an UNC13A mature mRNA and/or restoring UNC13A expression in a subject), biological, pharmacological, therapeutic (e.g., treatment of an UNC13A associated disease or a disease associated with TDP-43 dysfunction in a subject), or preventive result. The amount administered will likely depend on such variables as the overall health status of the patient, the relative biological efficacy of the compound delivered, the formulation of the drug, the presence and types of excipients in the formulation, and the route of administration. Also, it is to be understood that the initial dosage administered can, in some instances, be increased beyond the above upper level to rapidly achieve the desired blood-level or tissue level, or the initial dosage can, in some instances, be smaller than the optimum.

The terms "hybridize" and "hybridization" refer to the pairing of complementary compounds (e.g., an antisense oligonucleotide and its target nucleic acid). While not limited to a particular mechanism, the most common mechanism of pairing involves hydrogen bonding, which may be Watson-Crick, Wobble, Hoogsteen or reversed Hoogsteen hydrogen bonding, between complementary nucleobases.

The term "internucleoside linkage." as used herein, means a covalent linkage between adjacent nucleosides in an oligonucleotide (e.g., antisense oligonucleotide described herein). An internucleoside linkage may be a natural phosphodiester internucleoside linkage, or may be a modified (non-natural) internucleoside linkage. Modified internucleoside that may be used in an antisense oligonucleotide disclosed herein include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, mesyl phosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050. In some embodiments, in any one of the antisense oligonucleotides disclosed herein, all of the internucleoside linkages are stereorandom.

The term, "nucleoside," as used herein, refers to a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety. The term "nucleoside" encompasses a natural nucleoside and chemically modified nucleosides (e.g., with modifications in the base and/or sugar moiety).

The term "nucleotide," as used herein, refers to a compound comprising a nucleoside linked to a phosphate group. As used herein, "linked nucleosides" may or may not be linked by phosphate linkages and thus includes, but is not limited to "linked nucleotides." As used herein, "linked nucleosides" are nucleosides that are connected in a continuous sequence (i.e., no additional nucleosides are present between those that are linked). The term "nucleotide" encompasses a natural nucleotide and chemically modified nucleotides (e.g., with modifications in the base, sugar moiety, and/or phosphate group).

The term "nucleobase." as used herein, refers to nitrogen-containing compounds that can be linked to a sugar moiety to create a nucleoside that is capable of incorporation into an oligonucleotide, and wherein the compound is capable of bonding with a complementary naturally occurring nucleobase of another oligonucleotide or nucleic acid. Nucleobases may be naturally occurring or may be modified. As used herein a "naturally occurring nucleobase" is adenine (A), thymine (T), cytosine (C), uracil (U), and guanine (G). The term "nucleobase" encompasses 5'-methylated bases (e.g., 5'-methyl cytosine or 5'-methyl guanine).

The term "modified internucleoside linkage" refers to a linkage between two nucleosides (e.g., in an oligonucleotide) that is not the natural phosphodiester linkage. Non-limiting examples of modified internucleoside linkages include phosphorothioates, phosphorodiamidates, phosphotriesters, methyl phosphonates, short chain alkyl or cycloalkyl intersugar linkages or short chain heteroatomic or heterocyclic intersugar linkages.

The term "nucleoside modification" or "modified nucleoside" means a nucleoside that has one or more modifications to the nucleoside, including modifications to the nucleobase moiety and/or the sugar moiety. Any of the modified chemistries or formats of nucleosides described herein can be combined with each other. Non-limiting examples of modified nucleosides includes 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), 2'-O—N-methylacetamide (2'-O-NMA), locked nucleic acid (LNA, methylene-bridged nucleic acid), unlocked nucleic acid (UNA), ethylene-bridged nucleic acid (ENA), 2'-O, 4'-C-Spirocyclopropylene bridged nucleic acid (scpBNA), amido-bridged nucleic acid (AmNA), or 2'-O, 4'-C-aminomethylene bridged nucleic acid (BNA (NC)), and(S)-constrained ethyl-bridged nucleic acid (cEt) modified nucleosides. Further non-limiting examples of modified nucleosides include a conformationally restricted nucleoside, an abasic nucleoside, a 2'-amino-modified nucleoside, a morpholino nucleoside, a phosphoramidate, a non-natural base comprising nucleoside, a tetrahydropyran modified nucleoside, a 1,5-anhydrohexitol modified nucleoside (HNA), a cyclohexenyl modified nucleoside (CeNA), a nucleoside comprising a phosphorothioate group, a nucleoside comprising a methylphosphonate group, a nucleoside comprising a 5'-phosphate, a nucleoside comprising a 5'-phosphate mimic, a thermally destabilizing nucleoside, a glycol modified nucleoside (GNA).

The term "2'-modified nucleoside" refers to a nucleoside having a sugar moiety modified at the 2' position, meaning the sugar moiety comprises at least one 2'-substituent group other than H or OH. Non-limiting examples of 2'-modified nucleosides include: 2'-O-methoxyethyl (2'-MOE), 2'-O-Methyl (2'-O-Me), 2'-fluoro (2'-F), LNA (2'-4' methylene bridge), ENA (2'-4' ethylene bridge), or cEt (2'-4' ethylene bridge), 2'-deoxy, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), 2'-O—N-methylacetamide (2'-O-NMA), 2'-O, 4'-C-Spirocyclopropylene bridged nucleic acid (scpBNA), amido-bridged nucleic acid (AmNA), or 2'-O, 4'-C-aminomethylene bridged nucleic acid (BNA (NC)) modified nucleosides. In some embodiments, any one of the 2'-modified nucleosides described herein are high-affinity modified nucleosides and a modified antisense oligonucleotide has increased affinity to target sequences, relative to an unmodified antisense oligonucleotide. In some embodiments, at least one modified nucleoside is a 2'-modified nucleoside. In some embodiments, the 2'-modified nucleoside is a 2'-MOE modified nucleoside or an LNA or combinations thereof. In some embodiments, the 2'-modified nucleoside is a 2'-MOE modified nucleoside.

The term "modified oligonucleotide" or "modified antisense oligonucleotide" refers to oligonucleotides or antisense oligonucleotides that comprise one or more modified nucleosides and/or one or more modified internucleoside linkages. In some embodiments, a "modified oligonucleotide" or "modified antisense oligonucleotide" comprises a mix of modified nucleosides and unmodified nucleosides and/or a mix of modified internucleoside linkages and unmodified modified internucleoside linkages. In some embodiments, each nucleoside of a modified oligonucleotide" or "modified antisense oligonucleotide" is a modified nucleoside, and/or each internucleoside linkage of a modified oligonucleotide" or "modified antisense oligonucleotide" is a modified internucleoside linkage.

The term "region of complementarity." as used herein, refers to a nucleobase sequence, e.g., of an antisense oligonucleotide, that is sufficiently complementary to a cognate nucleobase sequence, e.g., of a target nucleic acid, such that the two nucleobase sequences are capable of annealing to one another under physiological conditions (e.g., in a cell). In some embodiments, a region of complementarity is fully complementary (e.g., 100% complementarity) to a cognate nucleobase sequence of target nucleic acid. In some embodiments, a region of complementarity is partially complementary to a cognate nucleobase sequence of target nucleic acid (e.g., at least 80%, 90%, 95% or 99% complementarity). In some embodiments, a region of complementarity contains 1, 2, 3, 4, or 5 mismatches compared with a cognate nucleobase sequence of a target nucleic acid.

The term "sequence identity." as used herein, refers to the extent that sequences are identical (independent of chemical modification) on a nucleobase-by-nucleobase basis or an amino acid-by-amino acid basis over a window of comparison. Thus, a "percentage of sequence identity" may be calculated by comparing two optimally aligned sequences over the window of comparison, determining the number of positions at which the identical nucleic acid base (e.g., A. T. C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., Nucl. Acids Res. 25:3389, 1997.

The term "restore" when referring to expression of a given gene (e.g., UNC13A), means that the expression of the gene, as measured by the level of RNA transcribed from the gene or the level of polypeptide, protein or protein subunit translated from the mRNA in a cell, group of cells, tissue, organ, or subject in which the gene is transcribed, is returned to normal levels (e.g., baseline level of gene expression in a subject that does not have an UNC13A-associated disease and/or abnormal UNC13A expression) when the cell, group of cells, tissue, organ, or subject is treated with an antisense oligonucleotide disclosed herein. In some embodiments, when a cell, group of cells, tissue, organ, or subject is treated with an antisense oligonucleotide disclosed herein, expression (e.g., protein and/or mRNA expression) of a target gene (e.g., UNC13A) is restored by at least 10%, at least 20%, at least 30%, at least 40%, at least 50%, at least 60%, at least 70%, at least 80%, at least 90% or at least 95% relative to a control, e.g., baseline level of gene expression prior to treatment.

The term "decrease" when referring to expression of TDP-43, means that the expression of the gene, as measured by the level of RNA transcribed from the gene or the level of polypeptide, protein or protein subunit translated from the mRNA in a subject in which the gene is transcribed, is reduced relative to expression of TDP-43 in a healthy subject or a subject that does not have an UNC13A-associated disease (e.g., ALS, FTD, Alzheimer's disease, or LATE). For example, a subject described herein having decreased expression of TDP-43 gene or protein by at least 10%, 20%, 30%, 40%, 50%, 60%, 70%, 80%, 90%, 95% or 100%, has decreased expression of TDP-43 relative to expression of TDP-43 in a subject that does not have an UNC13A-associated disease (e.g., ALS, FTD, Alzheimer's disease, or LATE). Expression of TDP-43 gene or protein may be measured by the level of RNA transcribed from the gene or the level of polypeptide, protein or protein subunit translated from the mRNA in a subject in which the gene is transcribed.

The term "single nucleotide polymorphism" or "SNP" is a genetic variation caused by changes in a single nucleobase. Without being bound by any particular theory, SNPs in UNC13A (e.g., intronic SNPs) typically increase cryptic splicing and alter direct binding of RNA-binding protein TDP-43, which reduces the ability of TDP-43 to repress cryptic exon inclusion in UNC13A during RNA splicing. SNPs may be associated with one or more diseases and may serve as genetic biomarkers for the one or more diseases. For example, SNPs can be used to predict drug exposure or effectiveness of a treatment in a subject. Non-limiting examples of SNPs associated with ALS include rs12608932, rs12973192, rs56041637, rs116169349, and rs62121687.

The term "subject." as used herein, refers to a mammal. In some embodiments, a subject is non-human primate, or rodent. In some embodiments, a subject is a human. In some embodiments, a subject is a patient, e.g., a human patient that has or is suspected of having a disease. In some embodiments, the subject is a human patient who has or is suspected of having an UNC13A-associated disease (e.g., a disease associated with abnormal UNC13A expression) and/or a disease associated with TDP-43 dysfunction in a subject. In some embodiments, the UNC13A-associated disease and/or a disease associated with TDP-43 dysfunction in a subject is a neurodegenerative disease (e.g., amyotrophic lateral sclerosis (ALS), frontotemporal dementia (FTD), Alzheimer's disease or Limbic-Predominant Age-Related TDP-43 Encephalopathy (LATE). In some embodiments, the subject has decreased expression of TDP-43 gene or protein. In some embodiments, the subject does not possess an SOD-1 gene mutation. SOD-1 gene mutations have been described, for example, in Miller et al., N Engl J Med 2022; 387:1099-110 and Ruffo et at., Genes 2022, 13, 537. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

The term "specificity" means the ability to inhibit the target RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS).

The term "symptom" as used herein, refers to any manifestation or indication of an underly disease. A symptom can be any biochemical, cellular, genetic, histological, and/or physiological observation, measurement, and/or test result in a subject that deviate from those of a control or reference.

For example, a symptom may be an elevated level of a liver enzyme, such as aminotransferases, as compared to a normal reference range.

The term "target sequence," as used herein, refers to a nucleoside sequence whose expression or activity is to be modulated. In some embodiments, the target sequence is a contiguous portion of the nucleoside sequence of a gene, a cDNA, a pre-mRNA, or an mRNA molecule formed during the transcription of a target gene, e.g., UNC13A gene, such an unprocessed UNC13A pre-mRNA transcript. In some embodiments, a target sequence disclosed herein is in an UNC13A pre-mRNA. In some embodiments, a target sequence disclosed herein is in an intron of an UNC13A pre-mRNA. In some embodiments, a target sequence disclosed herein is in intron 20 of UNC13A pre-mRNA. In some embodiments, a target sequence disclosed herein is in or near (e.g., within 100 nucleobases upstream or downstream of) a cryptic exon in intron 20 of UNC13A pre-mRNA.

The term "treat," "treatment." as used herein, mean the methods or steps taken to provide relief from or alleviation of the number, severity, and/or frequency of one or more symptoms of a disease (e.g., UNC13A-associated disease (e.g., a disease associated with abnormal UNC13A expression) or a disease associated with TDP-43 dysfunction) in a subject. As used herein, "treat" and treatment" may include the prevention, management, prophylactic treatment, and/or inhibition of the number, severity, and/or frequency of one or more symptoms of a disease (e.g., UNC13A-associated disease (e.g., a disease associated with abnormal UNC13A expression) or a disease associated with TDP-43 dysfunction) in a subject.

The term "variant" means a molecule (e.g., nucleic acid or polypeptide) that differs from a given molecule (e.g., a reference nucleic acid or polypeptide) in sequence (nucleic acid or amino acid respectively) by the addition (e.g., insertion), deletion, or conservative substitution of nucleic acids or amino acids, respectively, but that retains the biological activity of the given molecule. Changes in the reference nucleic acid sequence of the variant may be silent. That is, they may not alter the amino acid sequence encoded by the nucleic acid. Alternatively, changes in the nucleoside sequence of the variant may alter the amino acid sequence of a polypeptide encoded by the reference polynucleotide. Such nucleoside changes may result in amino acid substitutions, additions, deletions, fusions, and truncations in the polypeptide encoded by the reference sequence. The term "variant" encompasses fragments of a variant unless otherwise defined. A variant may be 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% identical to the reference sequence. The degree of homology (percent identity) between a native and a variant sequence can be determined, for example, by comparing the two sequences using freely available computer programs commonly employed for this purpose on the world wide web (e.g., BLASTn with default settings).

Definitions of specific functional groups and chemical terms are described in more detail below. The chemical elements are identified in accordance with the Periodic Table of the Elements, CAS version, *Handbook of Chemistry and Physics,* 75$^{th}$ Ed., inside cover, and specific functional groups are generally defined as described therein. Additionally, general principles of organic chemistry, as well as specific functional moieties and reactivity, are described in *Organic Chemistry*, Thomas Sorrell, University Science Books, Sausalito, 1999; Smith and March, *March's Advanced Organic Chemistry,* 5$^{th}$ Edition, John Wiley & Sons, Inc., New York, 2001; Larock, *Comprehensive Organic Transformations*, VCH Publishers, Inc., New York, 1989; and Carruthers, *Some Modern Methods of Organic Synthesis,* 3$^{rd}$ Edition, Cambridge University Press, Cambridge, 1987.

It is also to be understood that compounds that have the same molecular formula but differ in the nature or sequence of bonding of their atoms or the arrangement of their atoms in space are termed "isomers". Isomers that differ in the arrangement of their atoms in space are termed "stereoisomers".

Stereoisomers that are not mirror images of one another are termed "diastereomers" and those that are non-superimposable mirror images of each other are termed "enantiomers". When a compound has an asymmetric center, for example, it is bonded to four different groups, a pair of enantiomers is possible. An enantiomer can be characterized by the absolute configuration of its asymmetric center and is described by the R- and S-sequencing rules of Cahn and Prelog, or by the manner in which the molecule rotates the plane of polarized light and designated as dextrorotatory or levorotatory (i.e., as (+) or (−)-isomers respectively). A chiral compound can exist as either individual enantiomer or as a mixture thereof. A mixture containing equal proportions of the enantiomers is called a "racemic mixture".

The term "TDP-43," as used herein, means an RNA binding protein encoded by the TARDBP gene. TDP-43 has important role in RNA-processing activities and splicing regulatory function as a repressor of cryptic exon inclusion during RNA splicing. A key feature of neurodegenerative diseases, amyotrophic lateral sclerosis (ALS), frontotemporal dementia (FTD), Alzheimer's disease, and Limbic-Predominant Age-Related TDP-43 Encephalopathy (LATE) is mislocalization of TDP-43 from the nucleus and aggregated in the cytoplasm in human brain, neuronal cell lines motor neurons, and glial cells. It has been shown that TDP-43 dysfunction results in the inclusion of a cryptic exon in UNC13A mRNA and reduction of UNC13A protein expression. Diseases associated with TDP-43 dysfunction in a cell include the neurodegenerative diseases of ALS, FTD, Alzheimer's disease, and LATE.

The term "UNC-13 homolog A." used interchangeably with the term "UNC13A," refers to the well-known gene and polypeptide, also known in the art as Munc 13-1.

The term "UNC13A" includes human (*Homo sapiens*) UNC13A, the amino acid and nucleotide sequences of which may be found in, for example, GenBank Accession No. Gene ID: 23025, and NCBI Accession Nos. NG_052872.1:4991 . . . 92009 (SEQ ID NO: 318), NC_000019.10:17601336 . . . 17688354 complement (Reference GRCh38.p14 Primary Assembly) (SEQ ID NO: 318), NM_001080421.3 (SEQ ID NO: 307), and NP_001073890.2 (SEQ ID NO: 308). The term "UNC13A" also includes cynomolgus monkey (*Macaca fascicularis*) UNC13A, the amino acid and nucleotide sequences of which may be found in, for example, GenBank Accession No. GI: 102123626 and NCBI Accession Nos. NC_052273.1:17161646 . . . 17254007 complement (Reference MFA1912RKSv2 Primary Assembly) (SEQ ID NO: 319), XM_045380772.1 (SEQ ID NO: 309) and XP_045236707.1 (SEQ ID NO: 310). Additional examples of UNC13A RNA sequences are readily available using, e.g., GenBank, UniProt, and OMIM, and the *Macaca* genome project web site. Exemplary UNC13A nucleotide and amino acid sequences may also be found in Table 1, SEQ ID NOs: 307-310.

The term "UNC13A," as used herein, also refers to naturally occurring DNA sequence variations of the UNC13A gene. Numerous sequence variations within the UNC13A gene (e.g., SNPs rs12608932, rs12973192, rs56041637, rs116169349, rs62121687) have been identified and may be found at, for example, NCBI dbSNP and UniProt (see, e.g., ncbi.nlm.nih.gov/snp).

Further information on UNC13A can be found, for example, at ncbi.nlm.nih.gov/gene/23025. The entire contents of each of the foregoing Accession numbers and the Gene database numbers are incorporated herein by reference as of the date of filing this application.

Table 1 below summarizes exemplary amino acid sequences of UNC13A proteins and DNA sequences of UNC13A genes of human and cynomolgus monkey.

TABLE 1

Exemplary Amino Acid and DNA Sequences of UNC13A

| | Sequence | SEQ ID NO |
|---|---|---|
| Human UNC13A nucleotide (NM_001080421.3) | GCCCCCGGTGCTGAACCAAGATGGCCGGTGGCGGCCGGGCC<br>CCGGCGTGAGCCAAGCGCGGGCTGCAGCCGGGAGATGCCCC<br>AGCCCAGCGGCCGCTGAGCCCGACCCGACAGAGCCGGCCCG<br>GCCGCCTCCGGCCCACCTGCGAGCTCGGAGACATGTCTCTGC<br>TTTGCGTTGGAGTCAAAAAAGCCAAGTTTGATGGTGCCCAAG<br>AGAAATTCAACACGTACGTGACCCTGAAAGTGCAGAATGTC<br>AAGAGCACGACCATCGCGGTGCGGGGCAGCCAGCCCAGCTG<br>GGAGCAGGATTTCATGTTCGAGATTAACCGTCTGGATTTGGG<br>ACTGACGGTGGAGGTGTGGAATAAGGGTCTCATCTGGGACA<br>CAATGGTGGGCACTGTGTGGATCCCACTGAGGACCATCCGCC<br>AGTCCAATGAGGAGGGCCCTGGAGAGTGGCTGACGCTGGAC<br>TCCCAGGTCATCATGGCAGACAGTGAGATCTGTGGCACCAA<br>GGACCCCACCTTCCACCGCATCCTCCTGGACACGCGCTTTGA<br>GCTACCCTTAGACATTCCTGAAGAGGAGGCTCGCTACTGGGC<br>CAAGAAGCTGGAGCAGCTCAATGCTATGCGGGACCAGGATG<br>AATATTCGTTCCAAGATGAGCAAGACAAGCCTCTGCCTGTCC<br>CCAGCAACCAGTGCTGCAACTGGAATTATTTTGGCTGGGGTG<br>AGCAGCACAACGATGACCCCGACAGTGCAGTGGATGATCGT<br>GACAGTGACTACCGCAGTGAAACGAGCAACAGCATCCCGCC<br>GCCCTATTATACTACGTCACAACCCAACGCCTCAGTCCACCA<br>ATATTCTGTTCGCCCACCACCCCTGGGCTCCCGGGAGTCCTA<br>CAGTGACTCCATGCACAGTTACGAGGAGTTCTCTGAGCCACA<br>AGCCCTCAGCCCCACGGGTAGCAGCCGCTATGCCTCTTCCGG<br>GGAGCTGAGCCAGGGAAGCTCTCAGCTGAGCGAGGACTTCG<br>ACCCTGACGAGCACAGCCTGCAGGGCTCCGACATGGAGGAT<br>GAGCGGGACCGGGACTCCTACCACTCCTGCCACAGCTCGGTC<br>AGCTACCACAAAGACTCGCCTCGCTGGGACCAGGATGAGGA<br>AGAGCTGGAGGAGGACCTGGAGGACTTCCTGGAGGAGGAGG<br>AGCTGCCTGAAGATGAGGAGGAGCTGGAGGAGGAGGAGGA<br>GGAGGTGCCTGACGATTTGGGCAGCTATGCCCAGCGTGAAG<br>ACGTAGCTGTGGCTGAGCCCAAAGACTTCAAACGCATCAGC<br>CTCCCGCCAGCTGCCCCAGGGAAGGAGGACAAGGCCCCAGT<br>GGCACCCACCGAGGCCCCCGACATGGCCAAGGTGGCCCCCA<br>AGCCAGCCACGCCCGACAAGGTGCCTGCAGCTGAGCAGATC<br>CCTGAGGCTGAGCCACCCAAGGACGAGGAGAGTTTCAGGCC<br>GAGAGAGGATGAGGAAGGCCAGGAGGGGCAGGACTCCATG<br>TCCAGGGCCAAGGCCAACTGGCTGCGTGCCTTCAACAAGGT<br>GCGGATGCAGCTGCAGGAGGCCCGGGGAGAAGGAGAGATGT<br>CTAAATCCCTATGGTTCAAAGGCGGCCCAGGGGGCGGTCTCA<br>TCATCATCGACAGCATGCCAGACATCCGCAAGAGGAAACCT<br>ATCCCACTCGTGAGCGACTTGGCCATGTCCCTGGTCCAGTCC<br>AGGAAAGCGGGCATCACCTCGGCCTTGGCCTCCAGCACGTTG<br>AACAACGAGGAGCTGAAAAACCACGTTTACAAGAAGACCCT<br>GCAAGCCTTAATCTACCCCATCTCGTGCACGACGCCACACAA<br>CTTCGAAGTGTGGACGGCCACCACGCCCACCTACTGCTACGA<br>GTGCGAGGGGCTGCTGTGGGGCATCGCGAGGCAGGGCATGC<br>GCTGCACCGAGTGCGGTGTCAAGTGCCACGAGAAGTGCCAG<br>GACCTGCTCAACGCCGACTGCCTGCAGCGGGCTGCGGAGAA<br>GAGCTCCAAGCACGGGGCGGAGGACCGGACACAGAACATCA<br>TCATGGTGCTCAAGGACCGCATGAAGATCCGGGAGCGCAAC<br>AAGCCCGAGATCTTCGAGCTCATCCAGGAGATCTTCGCGGTG<br>ACCAAGACGGCGCACACGCAGCAGATGAAGGCGGTCAAGCA<br>GAGCGTGCTGGACGGCACGTCCAAGTGGTCCGCCAAGATCA<br>GCATCACCGTGGTCTGCGCCCAGGGCTTGCAGGCAAAGGAC<br>AAGACAGGATCCAGTGACCCCTATGTCACCGTCCAGGTCGG<br>GAAGACCAAGAAACGGACAAAAACCATCTATGGGAACCTCA<br>ACCCGGTGTGGGAGGAGAATTTCCACTTTGAATGTCACAATT<br>CCTCCGACCGCATCAAGGTGCGCGTCTGGGACGAGGATGAC<br>GACATCAAATCCCGCGTGAAACAGAGGTTCAAGAGGGAATC<br>TGACGATTTCCTGGGGCAGACGATCATTGAGGTGCGGACGCT<br>CAGCGGCGAGATGGACGTGTGGTACAACCTGGACAAGCGAA<br>CTGACAAATCTGCCGTGTCGGGTGCCATCCGGCTCCACATCA<br>GTGTGGAGATCAAAGGCGAGGAGAAGGTGGCCCCGTACCAT<br>GTCCAGTACACCTGTCTGCATGAGAACCTGTTCCACTTCGTG | 307 |

TABLE 1-continued

Exemplary Amino Acid and DNA Sequences of UNC13A

| Sequence | SEQ ID NO |
|---|---|
| ACCGACGTGCAGAACAATGGGGTCGTGAAGATCCCAGATGC | |
| CAAGGGTGACGATGCCTGGAAGGTTTACTACGATGAGACAG | |
| CCCAGGAGATTGTGGACGAGTTTGCCATGCGCTACGGCGTCG | |
| AGTCCATCTACCAAGCCATGACCCACTTTGCCTGCCTCTCCTC | |
| CAAGTATATGTGCCCAGGGGTGCCTGCCGTCATGAGCACCCT | |
| GCTCGCCAACATCAATGCCTACTACGCACACACCACCGCCTC | |
| CACCAACGTGTCTGCCTCCGACCGCTTCGCCGCCTCCAACTT | |
| TGGGAAAGAGCGCTTCGTGAAACTCCTGGACCAGCTGCATA | |
| ACTCCCTGCGGATTGACCTCTCCATGTACCGGAATAACTTCC | |
| CAGCCAGCAGCCCGGAGAGACTCCAGGACCTCAAATCCACT | |
| GTGGACCTTCTCACCAGCATCACCTTCTTTCGGATGAAGGTA | |
| CAAGAACTCCAGAGCCCGCCCCGAGCCAGCCAGGTGGTAAA | |
| GGACTGTGTGAAAGCCTGCCTTAATTCTACCTACGAGTACAT | |
| CTTCAATAACTGCCATGAACTGTACAGCCGGGAGTACCAGAC | |
| AGACCCGGCCAAGAAGGGGGAAGTTCTCCCAGAGGAACAGG | |
| GGCCCAGCATCAAGAACCTCGACTTCTGGTCCAAGCTGATTA | |
| CCCTCATAGTGTCCATCATTGAGGAAGACAAGAATTCCTACA | |
| CTCCCTGCCTCAACCAGTTTCCCCAGGAGCTGAATGTGGGTA | |
| AAATCAGCGCTGAAGTGATGTGGAATCTGTTTGCCCAAGACA | |
| TGAAGTACGCCATGGAGGAGCACGACAAGCATCGTCTATGC | |
| AAGAGTGCCGACTACATGAACCTCCACTTCAAGGTGAAATG | |
| GCTCTACAATGAGTATGTGACGGAACTTCCCGCCTTCAAGGA | |
| CCGCGTGCCTGAGTACCCTGCATGGTTTGAACCCTTCGTCAT | |
| CCAGTGGCTGGATGAGAATGAGGAGGTGTCCCGGGATTTCCT | |
| GCACGGTGCCCTGGAGCGAGACAAGAAGGATGGGTTCCAGC | |
| AGACCTCAGAGCATGCCCTATTCTCCTGCTCCGTGGTGGATG | |
| TTTTCTCCCAACTCAACCAGAGCTTTGAAATCATCAAGAAAC | |
| TCGAGTGTCCCGACCCTCAGATCGTGGGGCACTACATGAGGC | |
| GCTTTGCCAAGACCATCAGTAATGTGCTCCTCCAGTATGCAG | |
| ACATCATCTCCAAGGACTTTGCCTCCTACTGCTCCAAGGAGA | |
| AGGAGAAAGTGCCCTGCATTCTCATGAATAACACTCAACAG | |
| CTACGAGTTCAGCTGGAGAAGATGTTCGAAGCCATGGGAGG | |
| AAAGGAGCTGGATGCTGAAGCCAGTGACATCCTGAAGGAGC | |
| TTCAGGTGAAACTCAATAACGTCTTGGATGAGCTCAGCCGGG | |
| TGTTTGCTACCAGCTTCCAGCCGCACATTGAAGAGTGTGTCA | |
| AACAGATGGGTGACATCCTTAGCCAGGTTAAGGGCACAGGC | |
| AATGTGCCAGCCAGTGCCTGCAGCAGCGTGGCCCAGGACGC | |
| GGACAATGTGTTGCAGCCCATCATGGACCTGCTGGACAGCA | |
| ACCTGACCCTCTTTGCCAAAATCTGTGAGAAGACTGTGCTGA | |
| AGCGAGTGCTGAAGGAGCTGTGGAAGCTGGTTATGAACACC | |
| ATGGAGAAAACCATCGTCCTGCCGCCCCTCACTGACCAGACG | |
| ATGATCGGGAACCTCTTGAGAAAACATGGCAAGGGATTAGA | |
| AAAGGGCAGGGTGAAATTGCCAAGCCACTCAGACGGAACCC | |
| AGATGATCTTCAATGCAGCCAAGGAGCTGGGTCAGCTGTCCA | |
| AACTCAAGGATCACATGGTACGAGAAGAAGCCAAGAGCTTG | |
| ACCCCAAAGCAGTGCGCGGTTGTTGAGTTGGCCCTGGACACC | |
| ATCAAGCAATATTTCCACGCGGGTGGCGTGGGCCTCAAGAA | |
| GACCTTCCTGGAGAAGAGCCCGGACCTGCAATCCTTGCGCTA | |
| TGCCCTGTCGCTCTACACGCAGGCCACCGACCTGCTAATCAA | |
| GACCTTTGTACAGACGCAATCGGCCCAGGGCTTGGGTGTAGA | |
| AGACCCTGTGGGTGAAGTCTCTGTCCATGTTGAGCTGTTCAC | |
| TCATCCAGGAACTGGGGAACACAAGGTCACAGTGAAAGTGG | |
| TGGCTGCCAATGACCTCAAGTGGCAGACTTCTGGCATCTTCC | |
| GGCCGTTCATCGAGGTCAACATCATTGGGCCCCAGCTCAGCG | |
| ACAAGAAACGCAAGTTTGCGACCAAATCCAAGAACAATAGC | |
| TGGGCTCCCAAGTACAATGAGAGCTTCCAGTTCACGCTGAGC | |
| GCCGACGCGGGTCCCGAGTGCTATGAGCTGCAGGTGTGCGTC | |
| AAGGACTACTGCTTCGCGCGCGAGGACCGCACGGTGGGGCT | |
| GGCCGTGCTGCAGCTGCGTGAGCTGGCCCAGCGCGGGAGCG | |
| CCGCCTGCTGGCTGCCGCTCGGCCGCCGCATCCACATGGACG | |
| ACACGGGCCTCACGGTGCTGCGAATCCTCTCGCAGCGCAGCA | |
| ACGACGAGGTGGCCAAGGAGTTCGTGAAGCTCAAGTCGGAC | |
| ACGCGCTCCGCCGAGGAGGGCGGTGCCGCGCCTGCGCCTTA | |
| GCGCGGGCGGTCGGCCGAGCGGCACTGCGCCTGCGCGGAGG | |
| GCGCTGGGCGGGGAGGGACGGGGCTTGCGCCTTGGTGGGAC | |
| CTCCCCAGGGGCGGGGCTCGGGGGGCTCCACGCCAAGGGTG | |
| GGCTGCGCCTACGCCCTTGACTCAGCTTTCCCTTTTGGGGAA | |
| TTAGGAATGGAGGATGCCCCGCCCTCTCGGGAGGCCACGCC | |
| CAAGGGCGCGACGAAGGAAGGAGCCACATCCCCAACTTGAG | |
| GCCACGCCCCCAGCACCTAGGGGGCATTTTGAGCTGGGATG | |
| GGGGAAACCTCGTCCCTATGGAGGAGGCCACATCCCGGGGC | |
| TCTGGTACCGGGAGGCACCACCTCATGTCCCCTGGAAAAGCC | |
| ATAAGATGGGACCCAGACCCCTGGGACCCCAGACCAATTGC | |
| CAAGTATGGAAATCTCAGCTCCCTCGAGGGGGGGCCCTGGG | |
| CAAGGGGTAGGGCTCTCTGGAGCGCCCCTCTAGGTGGCCTGG | |
| GGACTGGAGGGACCAGGATGCTGGTTGGAGGGCCCCGGAAT | |

TABLE 1-continued

Exemplary Amino Acid and DNA Sequences of UNC13A

| Sequence | SEQ ID NO |
|---|---|
| ACCGGAGTCCCTTTAGATATTTGTGCAAAAAATAAATGGGGG | |
| GAGGGGGGAGGATGGGATTTCAAAAGCACATGCGCCCTTGG | |
| GCGCCCAAACCCTGGGGGCCGAGGGGACGGCTCTGGTTCCC | |
| CACGCTGCCCCTACTTCCCTTTGGGAGTTTGCCTCTCCCTCTC | |
| CCCCAACAAACCCAGTCCTCATATCATAGAGTTCAACACACC | |
| CATTTGACAGATGGCAAAACTGAGGCTTAAAGAGCTGCTTG | |
| AGACTTGGCCAAGGTTCCAGGTGCCATACCCTCTGTGCCCCT | |
| CCCTTAGGCCTGTGTGCCCCATGGAAGGGTGGGCTGAGATCG | |
| GGATGACCTGACACAGCTCCCTATTGCTGCTAATTCCCCCTC | |
| GGCCTCCTCCAAGGGGTGGGAATTCCAGGCCAAGACCCCTA | |
| CTTCGCCTTTCCTTCTCCGGCTGCCAAGCAGGACCTTTGCCCT | |
| CAGCCCTTTCTCCTGGGATCTCCATGGGGGATGCCATGAGGG | |
| CCTCCCACCACAAAAGAGAATTTGGGATCCCCTGGTCCCAGG | |
| TTTCTCCATCCCTTCTTCCTTTTCCAGAATTTTCCAAATAGGA | |
| AAGAACAGAAGGAGACCAGAAACTCTAGGGGGGAGAAAGA | |
| GAATGAGAGAAAGAGAATGAGAGAGAGAGAAACACAAACA | |
| CAGTGACACAGTGAGAGCTTAGTCTCCAAGAGCCTATTCATT | |
| GATTCAAACACCCAAGCCACAGGATACCTCAGATGGCCCTCT | |
| TGCCAGCTGGAAGCTCTTTCTCCAATGAGCAAAGTTACAGTG | |
| ACCTGGCTGGAGTTACCTGGTGCACATAGGACCTTAGGGGA | |
| AAGTTCAGCGTGGACTACACTTGCTCTGGGATCTGCTTTTCC | |
| ACATGTGTGTATGGCACGCCTTTTTCTGCTGGATTGGGAAGG | |
| ACAAGATTTTGCTGTGCTAGGGAGAAATGAAAACGGGGTGA | |
| GCTGAGTAGCTGGGTTTCTGGAGGATAGAACATCAGATGGG | |
| GAGGCTTTCCGAGGTGAAGAATGAGAGGGAACCACTTACTA | |
| GAGAGAAAAGAGCTCCAGGCCTGGGGAACAGCACGTGCGAA | |
| GGCCAGGAGAGAAGAACTGTTGAAACAACGAGAAGGGTGG | |
| CACGGCTGGAGCTGAGCCAGCAAGGGGGATCGTGAGGAGCC | |
| TTGGGGTTGGGGAGATCTGCAGAAGCATCAGACCAGGCAGG | |
| GCCTCGTACGCAGTCCTGAGGAGTTTTACTTTTATTCTAAGA | |
| CAGTTGGGGAGCTCCAGGAGCTGTTTTAAGTTGGGGAGAGA | |
| CTGGATTCCAGCCTGCAAAAGCTGTTTTGTGAAGACTAAAAC | |
| CAGTGAGGAGAGGTGGAGGTGCTTTGGGGACACTGAAATGG | |
| ATTCTTGGAAAGATTCTGAAGGCTGTGTTGAAAAGACACCTA | |
| TAGCTGTGGGGACATGACTATAATCCCAGCATTTGGGGAGAC | |
| CGAGGCTGGCAGATCACTTAAGGTCAGGAGTTTGAGACCAG | |
| CCTGGCCAACATGGCGAAACCCCATCTCTGCTAAAAATACAA | |
| AAATTAGCTGGGTGCAGTGGTGCATGCCTGTAGTCCCAGCTA | |
| CTCAGGAGACTGAGGCGGGAGAATTGTTTGAACCCTGGAGG | |
| CAGAGGTTGTAGTGAGTCGTGATCACACAACTGCACTCCAGC | |
| CTGGGCAACAGAACAATACTCCATTCCCTCCCCTCTACCCCA | |
| CCAAAAAAAAAAAAAAAATCCTGCCCTTAGATGAGCTCTAGG | |
| GCTGCTGAGTACAGTTGTCCCAGTTGCACAGTGCCCAAGGGT | |
| TTGGCATTGCTAAGAAGGCCACGTGCAAATCCTAGATATTGA | |
| GTGTTGTATGTTTGTGACGTTGGTTTCCCGACATGTGAATGG | |
| CCCAAGTGTCTGGAAGAAGTGGCGCCACTTTCTAATTTGCTT | |
| GGAGATGTTGCATGTCCCTTAAATTCAGACAGGTGCAGGTAA | |
| CTGGAGGTTCTGAACCAAAGGTTAAAATGCAAATTCTCATAC | |
| AGGGTTGGGAAGTTGTAGCCAGGGATAAGCTTATGTGACTGT | |
| TATATGGACTGAGGAGCAGATGTGAATTTCGAACCATGACAT | |
| GGCTGAGGGTAGGGGTCGGGTGGATGGATGATTCAGGGTTG | |
| TAACCCATAGAGCCCAAAGGGGAAGTGATCTGTGACCTGGG | |
| GTGAGGGTGATCTGGAAGATTTTTGGATGGCTGGAAAGAAA | |
| TGGGGAAGTCGAGCTGCCTGAGAGAGCCAAGTTATTTCCCA | |
| AAAGATTCCTTAGGAGTCTTTCTGTTCAAGACCTCCGTGTGT | |
| GTGTGTGTGTGTTTAGGGTTCCCCAGCAATGGCCCAGGCATG | |
| TGAAGGAAACAAGCTTCTTCAGGGAATATTTGTTGAATGAGT | |
| TTTCCTGACTCCCAGGCTAGAACTGTTTTTGCAATTTCCACCC | |
| TCTTTTCTTTCCCCCAGAGAACTCCTATTCGTCCTTCAAAACC | |
| CATCACGGAAACCCCTCTTGGAGAAAACCCTCCTTCCTTCCC | |
| CTCAGGACTTTCCCAGCCACCGTCTCTCCTCCAGTCCAGCCT | |
| GATGCCATGGGACTGGGGGTTTCTCTGTCCAGCTCTGTTTCTC | |
| CCAGACTGGGGTCTGAGGACTCTCAGGACCCCCAACTTTACC | |
| TAGCACAGGCTGGGCACAAGTGGGTGACAGGGAGTCTACGC | |
| CTAGTGGAATTATGTATTGGGGCAGGGTCAGTGTGAGAATAC | |
| ACATCCGCATGCATGTCTGTCCATGTCTGTCCGTACCAACCTT | |
| CCCCTTCCACACGGACCTGGGCACATAGGAGGTGTCTGAGCC | |
| TGACACATGGGACAGAGAGTGGACATGGCTGAGACACGGAC | |
| AGAGAAAAGACAAGGAGTCCAGGGGGCTGAAAGCCTTTTGA | |
| AATCAGGAAGTTCCTGTATTGGCAGAACAAAGCCCAGAGAG | |
| GAGCAGGGCTTTCCTCAACGCCACCCAGCAAGTGGACACAG | |
| AGCCCGGCCTTGGATGACACCTCCAGGGTTCTGAACCCTGGA | |
| CCTCGCTTTATGCAAGGAGCTGGCCCCACATTTCCATGAATC | |
| GGGGAAACAGCACAAGAAGGTTGGCCTGTGGCAGGGCAAGG | |
| GTTAAAGGGGTGACATTGAGGGATGCCTCAGAGTCAAAGTC | |
| CCCTGACCAAGAGGAATAGAGTAGAAAACACAGAGACAGA | |

TABLE 1-continued

Exemplary Amino Acid and DNA Sequences of UNC13A

| | Sequence | SEQ ID NO |
|---|---|---|
| | GGGTGAGATCACGCCCCGATGAGGACGGAGAGAGACAGAG<br>ATGGAGAGAGACATAGAGGTGGAAATATACAGAGAAAGAT<br>AAATGCAGAGACCAAGGCAGGGAGTGTCGGGGGAAGTAAA<br>GAGGGTGTCCTGAAGAAAGAAGGATCTGTTCACTCTTACCAG<br>TCTGTCCTCGAATGATTTGCATAAAATGAGGAGGTGCCTGTC<br>CACACCCCCAATTCCTCTCTCAGGCCCCAGAGCCTGAGACCT<br>CACCATGCCCCCATCAGAGATGCAAAAAACTAAACACCCAA<br>CTAGAAATCCTTGGGACCTCTCTCGGCTGGGATCTCAGAGCC<br>TTTCTGTCCCCTACCCCTACCCCATGTGCTGTCGATTTTGCAG<br>ATGGGGACAACCTGGGGCCTCCCGGAACTCTGCCACCCTGG<br>GGAAGTTGGGGGAGGGCCTTAGTCCCGGATCACAACCCCGT<br>CTGCTCCCCAGAATCCTTTCCTAAGAATCGTTGAGGACCAAA<br>GTTGTCTTTGCTGACACGTGTTGCTTTTCTCTTTGCCTTTTATT<br>GTTTCAGAGAAAAATCAAGTTGACTGTGTCAAGTAACACCCC<br>ACCCCTTACCCCCGTCCAGCCATAGTGGCTCTCTGGAGACAC<br>AGGTCACAGGCGGAGGGTCCCCTGATCATCCCCAACCACAC<br>AGCCAGGGGGACTTGACCCCTGTCCACCCCTGTCTCGTGCTC<br>CCTCAGACCCCCACAAACCGGCCAAGCAGTCCGGGGAGGCT<br>TCCCCTCCACACAACTCTTAGCATGTGATTGCAGATGTGAAA<br>TCAAAACGTTGTTTGTTTTTTGTTTTGTTTTGATTCTACCCCGT<br>CGGTCCAGTGTCTGCACAGACGCCTTCATTTCTCTGTAAATA<br>TGTGACTTGGAACAAATGTTTAACACAAACGAGAAGTGGTC<br>ATGAATGCATGGTGTTGAGATGTTTTGCACTATTCTGACTTTT<br>TGGTCTCTGTAAAAATATTTTATTAACAGCAGACATTAAAAA<br>AAGAAAAACCACACACA | |
| Human<br>UC13A<br>Protein<br>(NP_001073890.2) | MSLLCVGVKKAKFDGAQEKFNTYVTLKVQNVKSTTIAVRGSQ<br>PSWEQDFMFEINRLDLGLTVEVWNKGLIWDTMVGTVWIPLRTI<br>RQSNEEGPGEWLTLDSQVIMADSEICGTKDPTFHRILLDTRFELP<br>LDIPEEEARYWAKKLEQLNAMRDQDEYSFQDEQDKPLPVPSNQ<br>CCNWNYFGWGEQHNDDPDSAVDDRDSDYRSETSNSIPPPYYTT<br>SQPNASVHQYSVRPPPLGSRESYSDSMHSYEEFSEPQALSPTGSS<br>RYASSGELSQGSSQLSEDFDPDEHSLQGSDMEDERDRDSYHSC<br>HSSVSYHKDSPRWDQDEEELEEDLEDFLEEEELPEDEEELEEEE<br>EEVPDDLGSYAQREDVAVAEPKDFKRISLPPAAPGKEDKAPVA<br>PTEAPDMAKVAPKPATPDKVPAAEQIPEAEPPKDEESFRPREDE<br>EGQEGQDSMSRAKANWLRAFNKVRMQLQEARGEGEMSKSLW<br>FKGGPGGGLIIIDSMPDIRKRKPIPLVSDLAMSLVQSRKAGITSAL<br>ASSTLNNEELKNHVYKKTLQALIYPISCTTPHNFEVWTATTPTY<br>CYECEGLLWGIARQGMRCTECGVKCHEKCQDLLNADCLQRAA<br>EKSSKHGAEDRTQNIIMVLKDRMKIRERNKPEIFELIQEIFAVTK<br>TAHTQQMKAVKQSVLDGTSKWSAKISITVVCAQGLQAKDKTG<br>SSDPYVTVQVGKTKKRTKTIYGNLNPVWEENFHFECHNSSDRI<br>KVRVWDEDDDIKSRVKQRFKRESDDFLGQTIIEVRTLSGEMDV<br>WYNLDKRTDKSAVSGAIRLHISVEIKGEEKVAPYHVQYTCLHE<br>NLFHFVTDVQNNGVVKIPDAKGDDAWKVYYDETAQEIVDEFA<br>MRYGVESIYQAMTHFACLSSKYMCPGVPAVMSTLLANINAYY<br>AHTTASTNVSASDRFAASNFGKERFVKLLDQLHNSLRIDLSMY<br>RNNFPASSPERLQDLKSTVDLLTSITFFRMKVQELQSPPRASQVV<br>KDCVKACLNSTYEYIFNNCHELYSREYQTDPAKKGEVLPEEQG<br>PSIKNLDFWSKLITLIVSIIEEDKNSYTPCLNQFPQELNVGKISAE<br>VMWNLFAQDMKYAMEEHDKHRLCKSADYMNLHFKVKWLYN<br>EYVTELPAFKDRVPEYPAWFEPFVIQWLDENEEVSRDFLHGALE<br>RDKKDGFQQTSEHALFSCSVVDVFSQLNQSFEIIKKLECPDPQIV<br>GHYMRRFAKTISNVLLQYADIISKDFASYCSKEKEKVPCILMNN<br>TQQLRVQLEKMFEAMGGKELDAEASDILKELQVKLNNVLDELS<br>RVFATSFQPHIEECVKQMGDILSQVKGTGNVPASACSSVAQDA<br>DNVLQPIMDLLDSNLTLFAKICEKTVLKRVLKELWKLVMNTME<br>KTIVLPPLTDQTMIGNLLRKHGKGLEKGRVKLPSHSDGTQMIFN<br>AAKELGQLSKLKDHMVREEAKSLTPKQCAVVELALDTIKQYFH<br>AGGVGLKKTFLEKSPDLQSLRYALSLYTQATDLLIKTFVQTQSA<br>QGLGVEDPVGEVSVHVELFTHPGTGEHKVTVKVVAANDLKWQ<br>TSGIFRPFIEVNIIGPQLSDKKRKFATKSKNNSWAPKYNESFQFT<br>LSADAGPECYELQVCVKDYCFAREDRTVGLAVLQLRELAQRGS<br>AACWLPLGRRIHMDDTGLTVLRILSQRSNDEVAKEFVKLKSDT<br>RSAEEGGAAPAP | 308 |
| Cynomolgus<br>monkey<br>UNC13A<br>nucleotide<br>(XM_045380772.1) | GCCACGTCAGGCGCTGTCCGCGCCCCCGGTGCTGAACCAAG<br>ATGGCCGGTGGCGGCCGGGCCCCGGCGTGAGCCAAGCGCGG<br>GCTGCAGCCGGGAGATGCCCCAGCCCAGCGGCCGCTGAGCC<br>CGACCCGACAGAGCCGGCCCGGCCGCCTCCGGTCCGCCTGC<br>GAGCCCGGAGACATGTCTCTGCTGTGCGTTGGAGAGAAATTC<br>AACACGTACGTGACCCTGAAAGTTCAGAATGTCAAGAGCAC<br>GACCATCGCGGTGCGGGGCAGCCAGCCCAGCTGGGAGCAGG<br>ATTTCATGTTCGAGATTAACCGTCTGGATTTGGGACTGACAG<br>TGGAGGTGTGGAACAAAGGTCTCATCTGGGACACAATGGTG | 309 |

TABLE 1-continued

| Exemplary Amino Acid and DNA Sequences of UNC13A | |
|---|---|
| Sequence | SEQ ID NO |
| GGCACTGTGTGGATCCCACTGCGGACCATCCGCCAGTCCAAT<br>GAGGAGGGCCCTGGAGAGTGGCTGACACTGGACTCCCAGGT<br>CATCATGGCAGACAGTGAGATCTGCGGCACCAAGGACCCCA<br>CTTTCCACCGCATCCTCCTGGACACGCGCTTTGAGCTGCCCTT<br>AGACATTCCGGAAGAGGAGGCTCGCTACTGGGCCAAGAAGC<br>TGGAGCAGCTCAACGCTATGCGGGACCAGGATGAATATTCG<br>TTCCAAGATGAGCAAGACAAGCCTCTGCCTGTCCCCAGCAAC<br>CAGTGCTGCAACTGGAATTATTTTGGCTGGGGTGAGCAGCAC<br>AACGATGACCCCGACAGTGCAGTGGATGATCGCGACAGTGA<br>CTACCGCAGTGAAACGAGCAACAGCATCCCGCCGCCCTATTA<br>CACTACGTCGCAACCCAACGCCTCAGTCCACCAGTATTCTGT<br>TCGCCCACCACCCCTGGGCTCCCGGGAATCCTACAGCGACTC<br>CATGCACAGTTATGAGGAGTTCTCTGAGCCGCAGGCCCTCAG<br>CCCCACAGGTAGCAGCCGCTACGCCTCCTCAGCGGAGCTGA<br>GCCAGGGAAGCTCTCAGCTGAGTGAGGACTTCGACCCCGAC<br>GAGCACAGCCTGCAGGGCTCCGAGATGGAGGACGAGCGGGA<br>CCGGGACTCCTACCACTCCTGCCACAGCTCGGTCAGCTATCA<br>CAAAGACTCACCTCGCTGGGACCAGGATGAGGAGGAGCTGG<br>AGGAGGACCTGGAGGACTTCCTGGAGGAGGAGGAGCTGCCT<br>GAAGACGAGGAGGAGCTGGAGGAGGAGGAGGAGGTGCCTG<br>ACGATTTGGGCAGCTATGCCCAGCGTGAAGAGGTGGCTGTG<br>GCTGAGCCCAAAGACTTCAAACGCATCAGCCTCCCGCCAGCT<br>GCCCCAGGGAAGGAGGACAAGACCCCATTGGCACCCACCGA<br>GGCCCCCGACACGGCCAAGGTGGCCCCCAAGCCAGCCACAC<br>CCGAGGAGGTGCCTGCAGCTGAGCAGATCCCTGAGGCTGAG<br>CCCCCCAAGGCTGAGGAGAGTTTCAGGCCGAGAGAGGATGA<br>GGAAGGCCAGGAGGGGCAGGACTCCATGTCCAGGGCCAAGG<br>CCAACTGGCTGCGTGCCTTCAACAAGGTGCGGATGCAGCTGC<br>AGGAGGCCCGGGGTGAAGGAGAAATGTCCAAATCCCTATGG<br>TTCAAAGGCGGCCCAGGAGGTGGTCTCATCATCATCGACAGC<br>ATGCCAGACATCCGCAAGAGGAAACCTATCCCACTCGTGAG<br>CGACCTGGCCATGTCCCTGGTCCAGTCCAGGAAAGCAGGCAT<br>CACCTCGGCCTTGGCCTCCAGCACGTTGAACAACGAGGAGCT<br>GAAAAACCACGTTTACAAGAAGACCCTGCAAGCCTTAATCT<br>ACCCCATCTCGTGCACGACGCCACACAACTTCGAAGTGTGGA<br>CGGCCACCACGCCCACCTACTGCTACGAGTGCGAGGGGCTG<br>CTGTGGGGCATCGCGAGGCAGGGCATGCGCTGCACGGAGTG<br>TGGTGTCAAGTGCCACGAAAAGTGCCAGGACCTGCTCAACG<br>CCGATTGCCTGCAGCGGGCTGCGGAGAAGAGCTCCAAGCAC<br>GGGGCGGAGGACCGGACGCAGAACATCATCATGGTGCTCAA<br>GGACCGCATGAAGATCCGGGAGCGCAACAAGCCCGAGATCT<br>TCGAGCTCATCCAGGAGATCTTCGCGGTGACCAAGACGGCG<br>CACACGCAACAGATGAAGGCGGTCAAGCAGAGCGTGCTGGA<br>CGGCACGTCCAAGTGGTCCGCCAAGATCAGCATCACCGTGGT<br>CTGCGCGCAGGGCTTGCAGGCAAAGGACAAGACGGGATCCA<br>GTGACCCCTACGTCACCGTCCAGGTTGGGAAGACCAAGAAA<br>CGGACAAAAACCATCTATGGGAACCTCAACCCGGTGTGGGA<br>GGAGAATTTCCACTTTGAATGTCACAATTCCTCCGACCGCAT<br>CAAGGTGCGCGTCTGGGACGAGGATGATGACATCAAATCCC<br>GCGTGAAACAGAGGTTCAAGAGGGAATCTGACGATTTCCTG<br>GGGCAGACGATCATTGAGGTGCGGACGCTCAGCGGCGAGAT<br>GGACGTGTGGTACAACCTGGACAAGCGAACTGACAAATCTG<br>CTGTGTCGGGTGCCATCCGGCTCCACATCAGTGTGGAGATCA<br>AAGGCGAGGAGAAGGTGGCCCCATACCATGTCCAGTATACC<br>TGTCTGCATGAGAACCTGTTCCACTTTGTGACCGACGTGCAG<br>AACAATGGGGTTGTGAAGATCCCGGATGCCAAGGGCGACGA<br>TGCCTGGAAGGTTTACTACGATGAGACAGCCCAGGAGATTGT<br>GGACGAGTTTGCCATGCGCTACGGCGTTGAGTCCATCTACCA<br>AGCCATGACCCACTTTGCCTGCCTCTCCTCCAAGTATATGTG<br>CCCGGGGGTGCCTGCCGTCATGAGCACCCTACTCGCCAACAT<br>CAATGCCTACTACGCGCACACCACCGCCTCCACCAACGTGTC<br>TGCCTCTGACCGCTTCGCCGCCTCCAACTTTGGGAAAGAGCG<br>CTTCGTGAAACTCCTGGACCAGCTGCATAACTCCCTGCGGAT<br>TGACCTCTCCATGTACCGGAATAACTTCCCAGCCAGCAGCCC<br>AGAGAGACTCCAGGACCTCAAATCCACTGTGGACCTTCTCAC<br>CAGCATCACCTTCTTTCGGATGAAGGTACAAGAACTCCAGAG<br>CCCGCCCCGAGCCAGCCAGGTGGTAAAGGATTGTGTGAAAG<br>CCTGCCTTAATTCTACCTACGAGTACATCTTCAACAACTGCC<br>ATGAACTCTACAGCCGGGAGTACCAGACAGACCCGGCGAAG<br>AAGGGGGAAGTTCCCCCAGAGGAACAGGGGCCCAGCATCAA<br>GAACCTCGACTTCTGGTCCAAGCTGATTACCCTCATAGTGTC<br>CATCATTGAGGAAGACAAGAATTCCTACACTCCCTGCCTCAA<br>TCAGTTTCCCCAGGAGCTGAATGTGGGTAAAATCAGCGCTGA<br>AGTGATGTGGAATCTGTTTGCCCAAGACATGAAGTATGCCAT<br>GGAGGAGCACGACAAGCATCGTCTATGCAAGAGTGCCGACT<br>ACATGAACCTCCACTTCAAGGTGAAATGGCTCTACAATGAGT | |

TABLE 1-continued

Exemplary Amino Acid and DNA Sequences of UNC13A

| Sequence | SEQ ID NO |
|---|---|
| ATGTGACGGAACTTCCCGCCTTTAAGGACCGCGTGCCTGAGT | |
| ACCCTGCATGGTTTGAACCCTTCGTCATCCAGTGGCTGGACG | |
| AGAATGAGGAGGTGTCCCGGGATTTCCTGCACGGTGCCCTGG | |
| AGCGAGACAAGAAGGATGGGTTCCAGCAGACCTCAGAGCAT | |
| GCCCTATTCTCCTGCTCCGTGGTGGACGTCTTCTCCCAACTCA | |
| ACCAGAGCTTTGAAATCATCAAGAAACTTGAGTGTCCCGACC | |
| CCCAGATTGTGGGGCACTACATGAGGCGCTTTGCCAAGACCA | |
| TCAGTAATGTGCTCCTCCAGTATGCAGACATCATCTCCAAGG | |
| ACTTCGCCTCCTACTGCTCCAAGGAGAAGGAGAAAGTGCCCT | |
| GCATCCTCATGAACAACACTCAACAGCTACGAGTTCAGCTGG | |
| AGAAGATGTTCGAAGCCATGGGAGGAAAGGAGCTGGATGCC | |
| GAAGCCAGTGACATCTTGAAGGAGCTTCAGGTGAAACTCAA | |
| TAACGTCTTGGATGAGCTCAGCCGGGTGTTTGCTACCAGCTT | |
| CCAGCCGCACATTGAAGAGTGTGTTAAACAGATGGGTGACA | |
| TCCTTAGCCAGGTTAAGGGCACAGGCAATGTGCCAGCCAGT | |
| GCCTGCAGCAGCGTGGCCCAGGACGCTGACAATGTGTTGCA | |
| GCCCATCATGGACCTGCTGGACAGCAACCTGACCCTCTTTGC | |
| CAAAATCTGTGAGAAGACGGTGCTGAAGCGAGTGCTGAAGG | |
| AGCTGTGGAAGCTGGTTATGAACACTATGGAGAAAACCATC | |
| GTCCTGCCACCCCTCACCGACCAGACGATGATCGGGAACCTC | |
| TTGAGAAAACATGGCAAGGGATTAGAAAAGGGCAGGGTGAA | |
| ATTGCCAAGCCACTCAGACGGAACCCAGATGATCTTCAATGC | |
| AGCCAAGGAGCTGGGTCAGCTGTCCAAACTCAAGGACCACA | |
| TGGTACGAGAAGAAGCCAAGAGCTTGACCCCAAAGCAGTGC | |
| GCGGTGGTTGAGTTGGCCCTGGACACAATCAAGCAATATTTC | |
| CATGCGGGTGGCGTGGGCCTCAAGAAGACCTTCCTGGAGAA | |
| GAGCCCGGACCTGCAATCCCTGCGCTATGCCCTGTCGCTCTA | |
| CACACAGGCCACCGACCTGCTCATTAAGACCTTTGTACAGAC | |
| GCAATCGGCCCAGGTCCATGGTGGAAAAGGTACTAGGTTTA | |
| CCCTTAGTGAAGACATTTATCCTGAGAAGGGCTTGGGTGTAG | |
| AAGACCCTGTGGGTGAAGTCTCCGTCCACGTTGAGCTGTTTA | |
| CTCATCCAGGAACTGGGGAACACAAGGTCACAGTGAAAGTG | |
| GTGGCTGCCAATGACCTCAAATGGCAGACTTCTGGCATCTTC | |
| CGGCCGTTCATCGAGGTCAACATCATTGGGCCCCAGCTCAGC | |
| GACAAGAAACGCAAGTTTGCGACCAAATCCAAGAACAATAG | |
| CTGGGCTCCCAAGTACAATGAGAGCTTCCAGTTTACGCTGAG | |
| CGCCGACGCGGGCCCCGAGTGCTACGAGCTGCAGGTGTGCG | |
| TCAAGGACTACTGCTTCGCGCGCGAGGACCGCACGGTGGGG | |
| CTGGCCGTGCTGCAGCTGCGCGAGCTGGCCCAGCGCGGGAG | |
| TGCCGCCTGCTGGCTGCCGCTAGGCCGTCGCATCCACATGGA | |
| CGACACCGGCCTCACGGTCCTGCGAATCCTCTCGCAGCGCAG | |
| CAACGACGAGGTGGCCAAAGAGTTCGTGAAACTCAAGTCGG | |
| ACACGCGCTCAGCCGAGGAGGGTGGTGCCGCGCCTGCGCCT | |
| TAGCGCGGGGGGGGCGGCCGAGCGGCACTGCGCCTGCGCGG | |
| AGGGCGCTGGGCGGGGAGGGGCTTGCGTCTCGGTGGGACCT | |
| CCCCAGGGGCGGGGCTCGGGAGACTACACGCCGAGGGTGGG | |
| CTGCGCCTACGCCCTTGACTGAGCTCTCCCTTTTGGAGAATT | |
| AGGAATGGAGGATGCCCCGCCCTCTCGGGAGGCCACGCCCA | |
| AGGGCGCGATGAAGGAAGAAGCCACATCCCCAACTTGAGGC | |
| CACGCCCCCAGCATCTAGGGGGCATTTTGAGCTGGGATGGG | |
| GGAAACCTCGTCCCCATGGAGGAGGCCACATCCCGGCGCTC | |
| CGGTACTGGGAGGCACAGCCTCCTGTCCCCTGGAAAAGCCAT | |
| AAGACGGGACCCAGACCCCTGGGACCCCAGACCAATTGCCA | |
| AGTATGGAAATCTCAGCTCCCTCAAGGGGGGGCCCTGGGCA | |
| AGGGATAGAGCTTCCTGGAGGGCCCCTCTAGGTGATCTGGG | |
| GACTGGAGGGACCAGGATTCTGGTTGGAGGGCCCCGGAATA | |
| CCGGAGTCCCTTTAGATGTTTGTGCAAAAAATAAATGGGGGG | |
| AGGGGGGAGGATGGGATTTCAAAAGCACATGCGCCTTGGGC | |
| GCCCAAACCCTGGGGGCCGAGGGGACGGCTCTGGGGCACCC | |
| ACGCTGCCCCTACTTCCCTTTGGGAGTTTGCCTCTCCCTCTCC | |
| CCCAACAAACCCAGTCCTCATATCATAGATTTCAACACACCC | |
| ATTTGACAGATGGCAAAACTGAGGCTCAAAGAGCTGCTTGA | |
| GACTTGGCCGAGGTTCCAGGTGCCATACCCTCTATTCCTCTC | |
| CCTTAGGCCTGTGTGCCCCATGAAAGGGTGGGCTGAGATCGG | |
| GATGACCTGACACAGCTCCCTATTGCTGCTAATTCCCCCTCG | |
| GGGGCCTCCTCCAAGGGGTGGGAGTTCCAGGCCAAGACCCC | |
| TACTTTGCCTTTCCTTCTCCGGCTGCCAAGCAAGACCCCTGCC | |
| CTCAGCCCTTTCTCCTGGCATTCCATGGGGGATGCCATGAGG | |
| ACCTCCCACCACAAAAGAGAATTTGGGATCCCCTGGTCCCAG | |
| GTTTCTCCACCCCTTCTTCCTTTCCCAGAATTTTCCAAATAGG | |
| AAAGAACAGAAAGAAACCAGAAACTCTAGGGGGGAGAGAG | |
| AGAATGAGAGAGAGAGAAAGAGAGAGAGAGAGAAACCCAA | |
| ACACAGTGAGAGCTTAGTCTCCAAGATCCTATTTATTGATTC | |
| AAACACCCAAGCCACAGGATACCTCAGATGGCCCTCTAGCCT | |
| GCTGGAAGCCCTTTATCCAGTAAGCAAAGTTGCCGTGACTTG | |
| GCTGCAGTTAACCTTGTGCACACAGGACCTTAGGGGAAAGTT | |

TABLE 1-continued

Exemplary Amino Acid and DNA Sequences of UNC13A

| Sequence | SEQ ID NO |
|---|---|
| CAGTGTGGACCATATTTGCTCTGGGATCTGCTTTTCCTCGTGC<br>TCGTATGGCACGCCTTTTTCTGCTGGATTGAGAAAGACAAGA<br>TTTTGCTGTGCTAGGGAGAAATGAAAACGGGGTGAGATGAG<br>TAGCTGGGTTCCTGGAGGATGGAACATCAGATGGGGAGGCT<br>TTCTGAGGTGAAGAATGAGAGGGAACCACTTACTAGAGAGA<br>AAAGAGCTCCAGGCCTGGGAACAGCATGTGCGAAGACCAGG<br>AGAGGAGAACTGTTGAAACAAGGAGAAAGGTGGCACAGCTG<br>GAGCTGAGCCAGCAAGGGGGATCATGAGGAGCCTTGGGGTT<br>GGGGAGATCTGCAGAAGCATCAGACCAGGCAGGACCTTGTA<br>CGCTGTCCTGAGGAGTTTCACTTTTATTCTAAGACAGTCGGG<br>GAGCTCCAGGAGATGTTTAAGCTGGGGAGAGATTGGATTCC<br>AGCCTGCAAAAGCTGTTTTGTGAAGACTAAAACCAGTGAGG<br>AGGGGTGGGGGTGCTTTGGAGACACTGAAATGGATTATTGG<br>AAAGATTCTGAAGGCTGTATTGAAAAGACACCTATAACTGTG<br>GACATGGCTATAATCCCAGCATTTTGGGGAGGCTGAGGCTGG<br>TGGATCATTTAAGGTCAGGAGTTTGAGACCAGCCTGGCCAAC<br>GTGGTGAAACCCTGTCTCTGCTAAAAATACAAAAATTAGCTG<br>GGTGTGGTGGTGCATGCCTGTAATCCCAGCTACACAGGAGAC<br>TGAGGTGGGAGAATTGCTTGAACCCTGGAGGCAGAGGTTGC<br>AGTGAGCCAAGATCACACCACTGCACTCCAGCCTGGGTAAC<br>AGACCAATACTCCGTTCCCTCCCCTCTACCCCCCCCAAAAAA<br>AAAAAAAATCCTGCGCTTAGATGAGCTCCATGGCTGCTGAGT<br>ACAGTTGTCCCAGTTGCACACTGCCCAAGGGTTTGGCATCGC<br>TAAGAAGGCCACGTGCAAATCCTAGACATTGAGTGTTGTATG<br>TTTATGACCTTGGTGTCCCAACATGTGAATGGCCCAAGTGTC<br>TGGAAGAAGTGGCGCCACTTTCTAATTTGCTTGAAGGTGTTG<br>CGTGTCCCCTAAATTCAGACAGATGCAGGTAACTGGAGGTTC<br>TGAACCAAAGGCTAAAATGCAAATTCTCATAAAGGATTTGG<br>GAAGCTGTAGCCAGGGATAAGCTTATGTGACTGTAATATGG<br>GCTGAGGAGCAGATGTGAATTTCGGACCATGCCATGCCTGA<br>GGGTGGGGGTCGGGTGGATGGATGATTCAGGGTTGTAACCC<br>ATAGAGCCCAAAGGGGAAGTTATCTGTGACCTGTGGTGAGG<br>GTGACCTGGAACATTTTTGGATGGCTGGAAAGAAATGGGGA<br>AATTGAGCTGCCTGAGATAGTCAGGATATTTCCCAAAAGATT<br>CCTTAGGAGTCTTTCTGGTCAAGACGTGTGTGTGTGTGTGTG<br>TGTGTGTTTAGGGTTCCCCAAGAATGGCTCAGGCATGTGAAG<br>GAAACAAGCTTCAGGGAATATTTGTTGAATGAGTTTTCCTGC<br>CTCCCAGGCTAGAACTGTTTTTGCAATTTCCACCCTCTTTTCT<br>TTCCCTCCCAGAGAACTCCTATTCATCCTTTGAAACCCATCAT<br>GAAAATCCCTCTTGGAGAAAACCCTCCTTCCTTCCCCTCAGG<br>ACTTTCCCAGCCTCCATCCCTCCTCCAGTCCAGCCTGATGCCA<br>TGGGACTGGGGTTTCTCTCTTCAGCTCTGTTTCTCCCAGACTG<br>GGGTCTGAGGCCTCTCAGGACCCCCAACTTTACCTAGCACAG<br>GTTGGGCACAGGTGGATGGCAGGGAGTCTGTGCCTAGTGGA<br>ATTATGTGTTGGGGCAGTGTCAGTGCGAGAATACACATCTGC<br>ATGTGTATCTGTCCATGTCTGTCCATACCAACCTTCCCCTTCC<br>ACACGGACCTGGGCACATAGGAGGTGTCTGAGCCCAACACA<br>TGGGACAGAGAGTGGACACGGCTGAGACACGGACAGAGAC<br>AAGACAAGGAGTCCAGGCGGCTGAAAGCCTTTTGAAATCAG<br>GAAGTTCCTGGATTGGCAGAACAAAGCCCAGAGAGGAGCAG<br>GGCTTTCCCCATCGCCACCCAGCAAGTGGCCACAGAGCCCAG<br>CCTTGGATGACACCTCCAGGATTCTGAACCCTGGACCTCACT<br>TTATGCAAGGAGCTGGCCGCAGATTTCCATGAATCAGGGAA<br>ACAGCACAAGAGGGTTGGCCTGTGGCAGGGCAGGGATTAAA<br>GGGGTAACATTGAGGGATGCCTCAGAGTCAAAGTCCCCTGA<br>CCAAGAGGAATAAAGAGTAGAAGGCACAGAGAGGGTGAGA<br>TGACGCCCTGATGAGAACGGAGAGAGACATAGAGGTGGAAA<br>TATACAGAGAAAGAGAAATGCAGAGACCAGGGCAGGGGGT<br>GTCGGGGAAAGTAAAGAGGGTGTCCCGAGGAAAGAAGGCTC<br>TGTCCATTGTCACCAGTCTGTCCTCGAATGATTTGCATAAAA<br>TGAGGAGGTGCCTGTCCATGCCCCCAATTCCTCTCTCAGGTG<br>CCAGAGCCTGAGACCTCACCATGCCCCCATCAGAGATGCAA<br>AAAACTAAACACCCAACTAGAAATCCTTGGGACCTCTCTCGG<br>CTGGGATCTTAGAGCCTTTCTGTCCCCGACCCCTACCCCATGT<br>GCTGTCGATTTTGCAGATGGGGACAACCTGGGGCCTCCCGGA<br>ACTCTGCCACCCTGGGGAAGTTGGGGGGAGGGCGTTGGTCC<br>CGGATCACAACCCCGTCTGCTCCCCAGAATCCTTTCCTAAGA<br>ATCGTTGAGGACCAAAGTCGTCTTTGCTGACACGTGTTGCTT<br>TTCTCTTTGCCTTTTATTGTTTTAGAGAAAAATCAAGTTGACT<br>GTGTCAAGTAACACCCCACCCCCTTACCCCCGTCCAGCCATA<br>GTGGCTCTCTGGAGACACAGGTCACAGGCGGAGGGTCCCCT<br>GATCATCCCTGACCACACAGCCAGGGGTGTTTGACCCCTGTC<br>CACCCCTGTCTCGTGCTCCCTCAGACCCCCACAAACCGGCCA<br>AGCAGTCCGGGGATGCTTCCCCTCCACACAACTTCTCTTAGC<br>ATGTGATTGCAGATGTGAAATCAAAGCGTTGTTTGTTTTTTGT<br>TTTGTTTTGATTCCACCCCGTCGGTCTGGTGTCTGCACAGACG | |

TABLE 1-continued

Exemplary Amino Acid and DNA Sequences of UNC13A

| | Sequence | SEQ ID NO |
|---|---|---|
| | CCTTCATTTCTCTGTAAATATGTGACTTGGAACAAATGTTTAA<br>CACAAACGAGAAGTGGTCATGAATGCATGGTGTTGAGATGT<br>TTTGCACTATTCTGACTTTTTGGTCTCTGTAAAAATATTTTAT<br>TAACAGCAGACATTAAAAAAAGAAAAACCACA | |
| Cynomolgus monkey UNC13A Protein (XP_045236707.1) | MSLLCVGEKFNTYVTLKVQNVKSTTIAVRGSQPSWEQDFMFEI<br>NRLDLGLTVEVWNKGLIWDTMVGTVWIPLRTIRQSNEEGPGE<br>WLTLDSQVIMADSEICGTKDPTFHRILLDTRFELPLDIPEEEARY<br>WAKKLEQLNAMRDQDEYSFQDEQDKPLPVPSNQCCNWNYFG<br>WGEQHNDDPDSAVDDRDSDYRSETSNSIPPPYYTTSQPNASVH<br>QYSVRPPPLGSRESYSDSMHSYEEFSEPQALSPTGSSRYASSAEL<br>SQGSSQLSEDFDPDEHSLQGSEMEDERDRDSYHSCHSSVSYHK<br>DSPRWDQDEEELEEDLEDFLEEEELPEDEEELEEEEEVPDDLGS<br>YAQREEVAVAEPKDFKRISLPPAAPGKEDKTPLAPTEAPDTAKV<br>APKPATPEEVPAAEQIPEAEPPKAEESFRPREDEEGQEGQDSMSR<br>AKANWLRAFNKVRMQLQEARGEGEMSKSLWFKGGPGGGLIII<br>DSMPDIRKRKPIPLVSDLAMSLVQSRKAGITSALASSTLNNEELK<br>NHVYKKTLQALIYPISCTTPHNFEVWTATTPTYCYECEGLLWGI<br>ARQGMRCTECGVKCHEKCQDLLNADCLQRAAEKSSKHGAEDR<br>TQNIIMVLKDRMKIRERNKPEIFELIQEIFAVTKTAHTQQMKAV<br>KQSVLDGTSKWSAKISITVVCAQGLQAKDKTGSSDPYVTVQVG<br>KTKKRTKTIYGNLNPVWEENFHFECHNSSDRIKVRVWDEDDDI<br>KSRVKQRFKRESDDFLGQTIIEVRTLSGEMDVWYNLDKRTDKS<br>AVSGAIRLHISVEIKGEEKVAPYHVQYTCLHENLFHFVTDVQNN<br>GVVKIPDAKGDDAWKVYYDETAQEIVDEFAMRYGVESIYQAM<br>THFACLSSKYMCPGVPAVMSTLLANINAYYAHTTASTNVSASD<br>RFAASNFGKERFVKLLDQLHNSLRIDLSMYRNNFPASSPERLQD<br>LKSTVDLLTSITFFRMKVQELQSPPRASQVVKDCVKACLNSTYE<br>YIFNNCHELYSREYQTDPAKKGEVPPEEQGPSIKNLDFWSKLITL<br>IVSIIEEDKNSYTPCLNQFPQELNVGKISAEVMWNLFAQDMKYA<br>MEEHDKHRLCKSADYMNLHFKVKWLYNEYVTELPAFKDRVPE<br>YPAWFEPFVIQWLDENEEVSRDFLHGALERDKKDGFQQTSEHA<br>LFSCSVVDVFSQLNQSFEIIKKLECPDPQIVGHYMRRFAKTISNV<br>LLQYADIISKDFASYCSKEKEKVPCILMNNTQQLRVQLEKMFEA<br>MGGKELDAEASDILKELQVKLNNVLDELSRVFATSFQPHIEECV<br>KQMGDILSQVKGTGNVPASACSSVAQDADNVLQPIMDLLDSNL<br>TLFAKICEKTVLKRVLKELWKLVMNTMEKTIVLPPLTDQTMIG<br>NLLRKHGKGLEKGRVKLPSHSDGTQMIFNAAKELGQLSKLKDH<br>MVREEAKSLTPKQCAVVELALDTIKQYFHAGGVGLKKTFLEKS<br>PDLQSLRYALSLYTQATDLLIKTFVQTQSAQVHGGKGTRFTLSE<br>DIYPEKGLGVEDPVGEVSVHVELFTHPGTGEHKVTVKVVAAND<br>LKWQTSGIFRPFIEVNIIGPQLSDKKRKFATKSKNNSWAPKYNES<br>FQFTLSADAGPECYELQVCVKDYCFAREDRTVGLAVLQLRELA<br>QRGSAACWLPLGRRIHMDDTGLTVLRILSQRSNDEVAKEFVKL<br>KSDTRSAEEGGAAPAP | 310 |

As used herein, “intron 20” of UNC13A refers to the intron between exon 20 and exon 21 of UNC13A pre-mRNA (e.g., as described in Brown et al., Nature. 2022 March; 603 (7899): 131-137). Intron 20 of UNC13A is also sometimes known in the art as intron 20-21 (see, for example, Ma et al. TDP-43 represses cryptic exon inclusion in the FTD-ALS gene UNC13A. Nature 603, 124-130 (2022)). In some embodiments, intron 20 of UNC13A corresponds to positions 45511-46798 of an UNC13A gene sequence as set forth in accession numbers: NC_000019.10:17601336 . . . 17688354 complement and NG_052872.1:4991 . . . 92009 (human UNC13A). In some embodiments, intron 20 of UNC13A comprises the nucleotide sequence set forth in SEQ ID NO: 311. One skilled in the art would understand that in an UNC13A pre-mRNA, the intron 20 sequence is SEQ ID NO: 311 with each thymine replaced with uracil (see SEQ ID NO: 325).

(SEQ ID NO: 311)

gtgagggtcattgctcggcccctcccatgccacttccactcaccattcct gcctgcccagctcttcctctttctggccacaccatccacactctcctggc -continued cctctgagactgcccgccatgccattccctttacctggaaaactcctccc tatccatcaaagtccagattcagggtcacctcctctgggaagcccacctt ggcctccaggttgactctcactactcatcatcaggttcttccttctattc cag*ccctaaccactcaggattgggccgtttgtgtctgggtatgtctcttc*

*cagCTGCCTGGGTTTCCTGGAAAGAACTCTTATCCCCAGGAACTAGTTTG*

*TTGAATAAATGCTGGTGAATGAATGAATGATTGAACAGATGAATGAGTGA*

*TGAGTAGATAAAAGGATGGATGGAGAGATGG*gtgagtacatggatggata gatggatgagttggtgggtagattcgtggctagatggatgatggatggat ggacagatggatggatatatgattgaactattgaaagtatagatgtatgg atgggtgaatttgggggtaattgttagatgatggatgagtatagatgaat gatggatggataacttgatgagtggatagatagattgctggatagatgat tgactgggtggatagatgaaatgttggatgagcagattaagttgtattgg atgggatggatggaagtgtggttgagttattagaaggaagattgagtaga -continued taggtgaatttgttgatagtcagatgggtagataggtagatggatggatg gatggatggatgtataggcagatggacaaatggatgaatgggtgggtgga tgaatggaaggatgtgtggttgaactattgcaagtattgataattgggtt cataatttctgaatatttagatggatggttgtgagtggctggtggacaga cgaaaaatggatggttggataaattgatgggtggatggatggttggttgt atgaaagaatgaatgattgggtaggtggattaagttgcggatcaatgtat gggatggatgaatggatggatggatggatgtgtggttgaattactgaaag gttggaagagtggatgggtgaaatttggggtagttagatgggtgggtgtg tggatggataaaagagtagatgaatgaattaatgaataaacaggcagatg gatgatgtaagctgccccagaccctgggacctctgacccccggcgacccc ttgcactctccatgacactttctctcccatggtggcag (SEQ ID NO: 325)

gugagggucauugcucggccccucccaugccacuuccacucaccauuccu gccugcccagcucuuccucuuucuggccacaccauccacacucuccuggc ccucugagacugcccgccaugccauucccuuuaccuggaaaacuccuccc uauccaucaaaguccagauucagggucaccuccucugggaagcccaccuu ggccuccagguugacucucacuacucaucaucagguucuuccuucuauuc cag*cccuaaccacucaggauugggccguuugugucuggguaugucucuuc*

*cag*CUGCCUGGGUUUCCUG*GAAAGAACUCUUAUCCCCAGGAACUAGUUUG*

*UUGAAUAAAUGCUGGUGAAUGAAUGAAUGAUUGAACAGAUGAAUGAGUGA*

*UGAGUAGAUAAAAGGAUGGAUGGAGAGAUGG*gugaguacauggauggaua gauggaugaguugguggguagauucguggcuagauggaugauggauggau ggacagauggauggauauaugauugaacuauugaaaguauagauguaugg augggugaauuugggguaauuguuagaugauggaugaguauagaugaau gauggauggauaacuugaugaguggauagauagauugcuggauagaugau ugacuggguggauagaugaaauguuggaugagcagauuaaguuguauugg augggauggauggaagugugguugaguuauuagaaggaagauugaguaga uaggugaauuuguugauagucagaugguagauagguagauggauggaug gauggauggauguauaggcagauggacaaauggaugaaugggugggugga ugaauggaaggauguguggguugaacuauugcaaguauugauaauugggguu cauaauuucugaauauuuagauggaugguugugaguggcugguggacaga cgaaaaauggaugguuggauaaauugauggguggauggaugguugguugu augaaagaaugaaugauuggguagguggauuaaguugcggaucaauguau gggauggaugaauggauggauggauggauguguggguugaauuacugaaag guuggaagaguggaugggugaaauuugggguaguagaugggugggugugu ggauggauaaaagaguagaugaaugaauuaaugaauaaacaggcagaugg augauguaagcugccccagacccugggaccucugacccccggcgaccccu ugcacucuccaugacacuuucucucccaugguggcag The term "cryptic exon," as used herein, refers to intronic sequences that are erroneously included in mature mRNA as a result of a splicing defect. Cryptic exons may introduce frameshifts or stop codons, among other changes in the resulting mRNA and can arise through single nucleotide polymorphisms (SNPs) in acceptor/donor splice sites or the activity of spliceosome or RNA-binding proteins such as TDP-43. Cryptic exons can be found in patient tissues from people affected by ALS, FTD, Alzheimer's disease, and LATE. In some embodiments, cryptic exons can be found in patient tissues from people affected by frontotemporal lobar degeneration (FTLD), Progressive supranuclear palsy (PSP), Primary lateral sclerosis (PLS), Progressive muscular atrophy (PMA), facial onset sensory and motor neuronopathy (FOSMN), cerebral age-related TDP-43 with sclerosis (CARTS), Parkinsons disease, Guam Parkinson-dementia complex (G-PDC), Multisystem proteinopathy (MSP), chronic traumatic encephalopathy (CTE), Autism, hippocampal sclerosis (HS), Hippocampal sclerosis dementia, Down syndrome, Huntington's disease, multiple sclerosis, Perry disease, peripheral myopathy, polyglutamine diseases (e.g., spinocerebellar ataxia 3, myopathies and Chronic Traumatic Encephalopathy), Rasmussen's encephalitis, attention deficit hyperactivity disorder, autism, central pain syndromes, anxiety or depression. In some embodiments, a cryptic exon disclosed herein is 128 nucleosides in length. In some embodiments, a cryptic exon disclosed herein is 178 nucleosides in length. In some embodiments, a cryptic exon disclosed herein is 431 nucleosides in length.

In some embodiments, a cryptic exon disclosed herein comprises the sequence set forth in SEQ ID NO: 312 and SEQ ID NO: 326 (see also, nucleosides 304-431 in SEQ ID NO: 311 and SEQ ID NO: 325; capitalized sequence):

(SEQ ID NO: 312)

CTGCCTGGGTTTCCTGGAAAGAACTCTTATCCCCAGGAACTAGTTTGTTG

AATAAATGCTGGTGAATGAATGAATGATTGAACAGATGAATGAGTGATGA

GTAGATAAAAGGATGGATGGAGAGATGG (SEQ ID NO: 326)

CUGCCUGGGUUUCCUGGAAAGAACUCUUAUCCCCAGGAACUAGUUUGUUG

AAUAAAUGCUGGUGAAUGAAUGAAUGAUUGAACAGAUGAAUGAGUGAUGA

GUAGAUAAAAGGAUGGAUGGAGAGAUGG

In some embodiments, a cryptic exon disclosed herein comprises the sequence set forth in SEQ ID NO: 334 and SEQ ID NO: 335 (see also, nucleosides 254-431 in SEQ ID NO: 311 and SEQ ID NO: 325; italicized sequence):

(SEQ ID NO: 334)

CCCTAACCACTCAGGATTGGGCCGTTTGTGTCTGGGTATGTCTCTTCCAG

CTGCCTGGGTTTCCTGGAAAGAACTCTTATCCCCAGGAACTAGTTTGTTG

AATAAATGCTGGTGAATGAATGAATGATTGAACAGATGAATGAGTGATGA

GTAGATAAAAGGATGGATGGAGAGATGG (SEQ ID NO: 335)

CCCUAACCACUCAGGAUUGGGCCGUUUGUGUCUGGGUAUGUCUCUUCCAG

CUGCCUGGGUUUCCUGGAAAGAACUCUUAUCCCCAGGAACUAGUUUGUUG

AAUAAAUGCUGGUGAAUGAAUGAAUGAUUGAACAGAUGAAUGAGUGAUGA

GUAGAUAAAAGGAUGGAUGGAGAGAUGG

In some embodiments, a cryptic exon disclosed herein comprises the sequence set forth in SEQ ID NO: 336 and SEQ ID NO: 337 (see also, nucleosides 1-431 in SEQ ID NO: 311 and SEQ ID NO: 325; underlined sequence):

(SEQ ID NO: 336)
GTGAGGGTCATTGCTCGGCCCCTCCCATGCCACTTCCACTCACCATTCCT

GCCTGCCCAGCTCTTCCTCTTTCTGGCCACACCATCCACACTCTCCTGGC

CCTCTGAGACTGCCCGCCATGCCATTCCCTTTACCTGGAAAACTCCTCCC

TATCCATCAAAGTCCAGATTCAGGGTCACCTCCTCTGGGAAGCCCACCTT

GGCCTCCAGGTTGACTCTCACTACTCATCATCAGGTTCTTCCTTCTATTC

CAGCCCTAACCACTCAGGATTGGGCCGTTTGTGTCTGGGTATGTCTCTTC

CAGCTGCCTGGGTTTCCTGGAAAGAACTCTTATCCCCAGGAACTAGTTTG

TTGAATAAATGCTGGTGAATGAATGAATGATTGAACAGATGAATGAGTGA

TGAGTAGATAAAAGGATGGATGGAGAGATGG (SEQ ID NO: 337)
GUGAGGGUCAUUGCUCGGCCCCUCCCAUGCCACUUCCACUCACCAUUCCU

GCCUGCCCAGCUCUUCCUCUUUCUGGCCACACCAUCCACACUCUCCUGGC

CCUCUGAGACUGCCCGCCAUGCCAUUCCCUUUACCUGGAAAACUCCUCCC

UAUCCAUCAAAGUCCAGAUUCAGGGUCACCUCCUCUGGGAAGCCCACCUU

GGCCUCCAGGUUGACUCUCACUACUCAUCAUCAGGUUCUUCCUUCUAUUC

CAGCCCUAACCACUCAGGAUUGGGCCGUUUGUGUCUGGGUAUGUCUCUUC

CAGCUGCCUGGGUUUCCUGGAAAGAACUCUUAUCCCCAGGAACUAGUUUG

UUGAAUAAAUGCUGGUGAAUGAAUGAAUGAUUGAACAGAUGAAUGAGUGA

UGAGUAGAUAAAAGGAUGGAUGGAGAGAUGG

As used herein, the term "UNC13A-associated disease," is a disease or disorder that is caused by, or associated with, abnormal UNC13A expression and/or activity. The term "UNC13A-associated disease" includes a disease, disorder or condition that would benefit from inhibiting inclusion of an UNC13A cryptic exon into an UNC13A mature mRNA and/or restoring UNC13A expression in a cell. In some embodiments, a subject having an UNC13A-associated disease (e.g., a disease associated with abnormal UNC13A expression) may benefit from inhibiting inclusion of an UNC13A cryptic exon into an UNC13A mature mRNA and/or restoring UNC13A expression in a cell in the subject. In some embodiments, an UNC13A-associated disease is a motor neuron disease that is characterized by neuronal loss. An UNC13A-associated disease may be neurodegenerative disease. In some embodiments, an UNC13A-associated disease is ALS. In some embodiments, an UNC13A-associated disease is FTD. In some embodiments, an UNC13A-associated disease is Alzheimer's disease. In some embodiments, an UNC13A-associated disease is LATE. In some embodiments, an UNC13A-associated disease is frontotemporal lobar degeneration (FTLD), Progressive supranuclear palsy (PSP), Primary lateral sclerosis (PLS), Progressive muscular atrophy (PMA), facial onset sensory and motor neuronopathy (FOSMN), cerebral age-related TDP-43 with sclerosis (CARTS), Parkinsons disease, Guam Parkinson-dementia complex (G-PDC), Multisystem proteinopathy (MSP), chronic traumatic encephalopathy (CTE), Autism, hippocampal sclerosis (HS), Hippocampal sclerosis dementia, Down syndrome, Huntington's disease, multiple sclerosis, Perry disease, peripheral myopathy, polyglutamine diseases (e.g., spinocerebellar ataxia 3, myopathies and Chronic Traumatic Encephalopathy), Rasmussen's encephalitis, attention deficit hyperactivity disorder, autism, central pain syndromes, anxiety or depression.

Further details regarding signs and symptoms of the various diseases or conditions are provided herein and are well known in the art.

Compositions

UNC13A Antisense Oligonucleotides

Some aspects of the present disclosure provide antisense oligonucleotides that target UNC13A and/or modulates UNC13A splicing and/or expression. In some embodiments, an antisense oligonucleotide disclosed herein comprises sequences complementary to an UNC13A sequence (e.g., UNC13A gene sequence or pre-mRNA sequence). In some embodiments, an antisense oligonucleotide disclosed herein targets more than one (e.g., two or more) target regions of UNC13A (e.g., UNC13A gene or pre-mRNA). In some embodiments, an antisense oligonucleotide disclosed herein is designed for splicing modulation of an UNC13A pre-mRNA (e.g., to inhibit the inclusion of a cryptic exon present in UNC13A pre-mRNA). In some embodiments, an antisense oligonucleotide disclosed herein is designed for modulation (e.g., restoring) of UNC13A gene expression (e.g., RNA expression and/or protein expression) and/or function.

In some embodiments, an antisense oligonucleotide disclosed herein comprises one or more regions of complementarity to one or more (e.g., one, two, or more) target regions in a human UNC13A sequence (e.g., as set forth in SEQ ID NO: 318). In some embodiments, an antisense oligonucleotide disclosed herein comprises one or more regions of complementarity to one or more (e.g., one, two, or more) target regions in in an intron (e.g., intron 20 such as the intron 20 as set forth in SEQ ID NO: 311) of a human UNC13A sequence (e.g., as set forth in SEQ ID NO: 318). In some embodiments, an antisense oligonucleotide disclosed herein comprises regions of complementarity to one or more (e.g., one, two, or more) target regions in intron 20 (e.g., the intron as set forth in SEQ ID NO: 311) of an UNC13A sequence (e.g., as set forth in SEQ ID NO: 318), wherein each target region each comprises an UNC13A sequence that modulates splicing of an UNC13A cryptic exon (e.g., an UNC13A cryptic exon present in intron 20 such as the cryptic exon as set forth in SEQ ID NO: 312, SEQ ID NO: 334, or SEQ ID NO: 336). In some embodiments, an antisense oligonucleotide described herein inhibits inclusion of an UNC13A cryptic exon (e.g., an UNC13A cryptic exon present in intron 20) into an UNC13A mature mRNA.

In some embodiments, an antisense oligonucleotide disclosed herein targets one or more (e.g., one, two, or more) target regions in intron 20 (e.g., the intron 20 as set forth in SEQ ID NO: 311) of an UNC13A sequence in or near a cryptic exon (e.g., the cryptic exon as set forth in SEQ ID NO: 312, SEQ ID NO: 334, or SEQ ID NO: 336). "Near" a position or a sequence, as used herein, means within 125 (e.g., 125, 120, 115, 110, 105, 100, 95, 90, 85, 80, 75, 70, 65, 60, 55, 50, 45, 40, 35, 30, 25, 20, 15, 10, 9, 8, 7, 6, 5, 4, 3, 2, or 1) nucleosides upstream (5' end) or downstream (3' end) of the position or sequence. "Upstream" of a position or a sequence, as used herein, means at the 5' side of the position or sequence. "Downstream" of a position or sequence, as used herein, means at the 3' side of the position or sequence. For example, a target region "near" a cryptic exon in intron 20 of UNC13A sequence means the target region is within 125 (e.g., 125, 120, 115, 110, 105, 100, 95, 90, 85, 80, 75, 70, 65, 60, 55, 50, 45, 40, 35, 30, 25, 20, 15, 10, 9, 8, 7, 6, 5, 4, 3, 2, or 1) nucleosides upstream (e.g., counting towards the 5' end from the 5' terminal nucleotide of the cryptic exon) or downstream (e.g., counting towards the 3' end from the 3' terminal nucleotide of the cryptic exon) of the cryptic exon in intron 20 of UNC13A sequence.

As used herein, a "target region" is represented by a nucleotide sequence in a reference sequence. For example, for target regions 1~4 provided in Table 2, the reference sequence used is human UNC13A sequence (SEQ ID NO: 318; NC_000019.10:17601336 . . . 17688354 complement and NG_052872.1:4991 . . . 92009). For the purposes of the present disclosure, when referring to antisense oligonucleotides that target a target region in a reference sequence (e.g., in human UNC13A sequence as set forth in NC_000019.10:17601336 . . . 17688354 complement and NG_052872.1:4991 . . . 92009; SEQ ID NO: 318), such antisense oligonucleotides encompass antisense oligonucleotides that target the target region in the reference sequence (SEQ ID NO: 318; NC_000019.10:17601336 . . . 17688354 complement and NG_052872.1:4991 . . . 92009), and antisense oligonucleotides that target a corresponding target region in another UNC13A sequence (e.g., gene sequence, pre-mRNA sequence, or a variant or a homologue of human UNC13A, e.g., from a closely related species, such as a cynomolgus monkey).

To identify a target region in another UNC13A sequence that corresponds to a certain target region in the reference sequence (e.g., SEQ ID NO: 318; NC_000019.10: 17601336 . . . 17688354 complement and NG_052872.1:4991 . . . 92009), such other UNC13A sequences can be aligned to the reference sequence and the corresponding target region can be determined. For example, in some embodiments, a target region in human UNC13A comprises a nucleotide sequence as set forth in SEQ ID NO: 327 (CTGGGTATGTCTCTTCCAGCTGCCTGGGTTTCCTG-GAAAGAACTCTTATCCCCAGG AACTAGTTTGTT-GAATAAATGCTGGTGAATGAATGA). Target region 1 corresponds to nucleosides at positions 45795-45886 of SEQ ID NO: 318 (human UNC13A; NC_000019.10: 17601336 . . . 17688354 complement and NG_052872.1: 4991 . . . 92009). Target region 1 of SEQ ID NO: 318 (NC_000019.10:17601336 . . . 17688354 complement and NG_052872.1:4991 . . . 92009; upper sequence) is aligned to the corresponding target region of the cynomolgus UNC13A sequence (nucleosides at positions 50846-50936 of cynomolgus UNC13A SEQ ID NO: 319 (NC_052273.1: 17161646 . . . 17254007 complement; lower sequence)) as follows:

```
CTGGGTATGTCTCTTCCAGCTGCCTGGGTTTCCTGGAAAGAACTCTTATCCCCAGGAACTAGTT
||||||||||||| |||||||||||||| |||||||||||||||  ||||||||||||||||||
CTGGGTATGTCTCCTCCAGCTGCCTGGGGTTCCTGGAAAGAACTG-TATCCCCAGGAACTAGTT

TGTTGAATAAATGCTGGTGAATGAATGA (SEQ ID NO: 327)
|||||||| |||||||||||||||||||
TGTTGAATGAATGCTGGTGAATGAATGA (SEQ ID NO: 330)
```

As such, positions 50846-50936 of cynomolgus UNC13A, SEQ ID NO: 319 (NC_052273.1:17161646 . . . 17254007 complement) is the corresponding target region 1. When referring to antisense oligonucleotides targeting target region 1 of an UNC13A sequence, the present disclosure encompasses antisense oligonucleotides targeting target region 1 of NC_000019.10:17601336 . . . 17688354 complement and NG_052872.1:4991 . . . 92009 (SEQ ID NO: 318) and antisense oligonucleotides that target the corresponding target region 1 of NC_052273.1:17161646 . . . 17254007 complement (SEQ ID NO: 319).

In determining a corresponding target region of another sequence in relation to a reference sequence, the other sequence and the reference sequence are optimally aligned over the window of comparison, which comprises sufficient number of nucleosides for the alignment. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., Nucl. Acids Res. 25:3389, 1997.

One or more insertions in another UNC13A sequence from a closely related species, such as a cynomolgus monkey, relative to the human reference sequence (SEQ ID NO: 318; NC_000019.10:17601336 . . . 17688354 complement and NG_052872.1:4991 . . . 92009) are represented as position "N-M." wherein N represents the corresponding position immediately before the insertions in the reference sequence, and M represents the position of the nucleoside within the one or more insertions. For example, in the following alignment between an area of the sequence set forth in SEQ ID NO: 318 (NC_000019.10:17601336 . . . 17688354 complement and NG_052872.1:4991 . . . 92009; upper sequence) and the sequence set forth in SEQ ID NO: 319 (NC_052273.1:17161646 . . . 17254007 complement; lower sequence),

```
TGA----TGGGTG
|||    ||||||
TGATGGGTGGGTG (SEQ ID NO: 331)
```

The insertions TGGG in SEQ ID NO: 319 (NC_052273.1: 17161646 . . . 17254007 complement) follows the position 46487 (bolded A in the alignment above) in SEQ ID NO: 318 (NC_000019.10:17601336 . . . 17688354 complement and NG_052872.1:4991 . . . 92009). Accordingly, the positions of insertions TGGG are designated as 46487-1, 46487-2, 46487-3, and 46487-4, respectively.

One or more deletions or mismatches in another UNC13A sequence from a closely related species, such as a cynomolgus monkey, relative to the human reference sequence (SEQ ID NO: 318; NC_000019.10:17601336 . . . 17688354 complement and NG_052872.1:4991 . . . 92009) may result in the lack of a "corresponding position." In these instances, as long as the deletions/mismatches (e.g., no more than 5, 4, 3, 2, 1 mismatches) are within a stretch of sequences of sufficient length (e.g., at least 20, 25, 30, 35, or 40 nucleosides) that aligned between the two sequences, the mismatched positions are represented as the position in the reference sequence that directly aligned even if the nucleoside in the reference is different. The position for the deletion in the other sequence is "skipped."

For example, the nucleosides at positions 46024-46036 of the human UNC13A sequence SEQ ID NO: 318 (NC_000019.10:17601336 . . . 17688354 complement and NG_052872.1:4991 . . . 92009; upper sequence) are aligned to the nucleoside 51070-51082 of the cynomolgus UNC13A sequence SEQ ID NO: 319 (NC_052273.1:17161646 . . . 17254007 complement; lower sequence) as follows:

GATATATGATTGA (SEQ ID NO: 332)
||||| ||| |||
GATATGTGACTGA (SEQ ID NO: 333)

The bolded A at position 46029 of SEQ ID NO: 318 (NC_000019.10:17601336 . . . 17688354 complement and NG_052872.1:4991 . . . 92009) aligns with the bolded G at position 51075 of SEQ ID NO: 319 (NC_052273.1:17161646 . . . 17254007 complement). When referring to antisense oligonucleotides that target an UNC13A sequence at a target region comprising the nucleoside at position 46029, the present disclosure encompasses antisense oligonucleotides that target a target region comprising the nucleoside at position 46029 of NC_000019.10:17601336 . . . 17688354 complement and NG_052872.1:4991 . . . 92009 (SEQ ID NO: 318) and antisense oligonucleotides that target a target region comprising the nucleoside at position 51075 of NC_052273.1:17161646 . . . 17254007 complement (SEQ ID NO: 319).

In some embodiments, an antisense oligonucleotide provided herein comprising a first antisense sequence targeting a first target region and a second antisense sequence targeting a second target region, wherein the first target region and/or the second target region each comprises an UNC13A sequence. In some embodiments, each of the first antisense sequence and the second antisense sequence comprises a region of complementary to an UNC13A sequence as set forth in SEQ ID NO: 318. In some embodiments, the region of complementary consists of at least 6 (e.g., at least 6, 7, 8, 9, 10, 11, 12, 13, 14, 15, 16, 17, 18, 19, 20, or more) nucleotides in length. In some embodiments, the region of complementary consists of at least 7 (e.g., at least 7, 8, 9, 10, 11, 12, 13, 14, 15, 16, 17, 18, 19, 20, or more) nucleotides in length. In some embodiments, the region of complementary consists of at least 8 (e.g., at least 8, 9, 10, 11, 12, 13, 14, 15, 16, 17, 18, 19, 20, or more) nucleotides in length.

In some embodiments, each of the first target region and the second target region is in intron 20 of an UNC13A sequence (e.g., gene sequence or pre-mRNA sequence). In some embodiments, each of the first antisense sequence and the second antisense sequence comprises a region of complementary to intron 20 of an UNC13A sequence, wherein the intron 20 is as set forth in SEQ ID NO: 311 or SEQ ID NO: 325. In some embodiments, the region of complementary consists of at least 6 (e.g., at least 6, 7, 8, 9, 10, 11, 12, 13, 14, 15, 16, 17, 18, 19, 20, or more) nucleotides in length. In some embodiments, the region of complementary consists of at least 7 (e.g., at least 7, 8, 9, 10, 11, 12, 13, 14, 15, 16, 17, 18, 19, 20, or more) nucleotides in length. In some embodiments, the region of complementary consists of at least 8 (e.g., at least 8, 9, 10, 11, 12, 13, 14, 15, 16, 17, 18, 19, 20, or more) nucleotides in length.

In some embodiments, each of the first target region and the second target region is near a cryptic exon in intron 20 of an UNC13A sequence (e.g., gene sequence or pre-mRNA sequence). In some embodiments, each of the first target region and the second target region comprises an UNC13A sequence, wherein targeting such sequences modulates splicing of an UNC13A cryptic exon (e.g., a cryptic exon in intron 20 of an UNC13A pre-mRNA). In some embodiments, targeting the UNC13A sequences using an antisense oligonucleotide described herein that modulate splicing of an UNC13A cryptic exon inhibits inclusion of the cryptic exon (e.g., a cryptic exon in intron 20 of an UNC13A pre-mRNA) in a mature UNC13A mRNA.

In some embodiments, the first target region and second target region are adjacent (e.g., within 300 nucleobases) to each other. In some embodiments, the first target region is downstream of the second target region. In some embodiments, the first target region is more than one nucleotide (2, 3, 4, 5, 6, 7, 8, 9, 10, 15, 20, 30, 40, 50, etc.) downstream of the second target region. In some embodiments, the first target region and the second target region are both in the cryptic exon (e.g., the cryptic exon in intron 20 of an UNC13A pre-mRNA). In some embodiments, the first target region is downstream of the cryptic exon (e.g., a cryptic exon in intron 20 of an UNC13A pre-mRNA) and the second target region is in the cryptic exon (e.g., a cryptic exon in intron 20). In some embodiments, the first target region and the second target region are both downstream of the cryptic exon (e.g., a cryptic exon in intron 20 of an UNC13A pre-mRNA). In some embodiments, the 5' end of the first target region and 3' end of the second target region have 1-300 nucleobases (e.g., 1-300, 3-300, 5-300, 7-300, 10-300, 1-250, 3-250, 5-250, 7-250, 10-250, 1-200, 3-200, 5-200, 7-200, 10-200, 1-150, 3-150, 5-150, 7-150, or 10-150 nucleobases) in between each other.

Non-limiting examples of target regions in an UNC13A pre-mRNA that may be targeted by an antisense oligonucleotide described herein are provided in Table 2. Such target regions are near the cryptic exon in intron 20 of an UNC13A sequence. One of ordinary skill in the art would appreciate that the target regions overlap and are not discrete regions. In some embodiments, antisense oligonucleotides disclosed herein that comprise antisense sequences targeting target regions 1 and 3 are particularly effective in skipping the cryptic exon, inhibiting inclusion of the UNC13A cryptic exon into an UNC13A mature mRNA.

TABLE 2

Exemplary target regions in intron 20 of UNC13A pre-mRNA

| Target regions | Sequence | SEQ ID NO: |
|---|---|---|
| Target region 1 | CUGGGUAUGUCUCUUCCAGCUGCCUGGG UUUCCUGGAAAGAACUCUUAUCCCCAGG AACUAGUUUGUUGAAUAAAUGCUGGUG AAUGAAUGA | 313 |
| Target region 2 | GAAUAAAUGCUGGUGAAUGAAUGAAUG AUUGAACAGAUGAAUGAGUGAUGAGUA GAUAAAAGGAUGGAUGGAGAGAUGGGU GAGUACAUGGAUGGA | 314 |
| Target region 3 | GAGAUGGGUGAGUACAUGGAUGGAUAG AUGGAUGAGUUGGUGGGUAGAUUCGUG GCUAGAUGGAUGAUGGAUGGAUGGACA GAUGGAUGGAU | 315 |
| Target region 4 | AUGGAUGGAUGGACAGAUGGAUGGAUA UAUGAUUGAACUAUUGAAAGUAUA | 316 |

‡It is to be understood that if the target sequence is a gene sequence (DNA), each uracil base (U) in any one of the target region sequences provided in Table 2 may be replaced with a thymine base (T).

In some embodiments, an antisense oligonucleotide disclosed herein comprises a first antisense sequence targeting a first target region and a second antisense sequence targeting a second target region. In some embodiments, the first antisense sequence targets a first target region comprising the nucleotide sequence of any one of SEQ ID NO: 313-316. In some embodiments, the first antisense sequence targets a first target region comprising the nucleotide sequence of in SEQ ID NO: 313 or SEQ ID NO: 315. In some embodiments, the second antisense sequence targets a second target region comprising the nucleotide sequence of any one of SEQ ID NO: 313-316. In some embodiments, the second antisense sequence targets the second target region comprising the nucleotide sequence of SEQ ID NO: 313 or SEQ ID NO: 315.

In some embodiments, an antisense oligonucleotide disclosed herein comprises a first antisense sequence targeting a first target region and a second antisense sequence targeting a second target region. In some embodiments, the first antisense sequence targets a first target region comprising the nucleotide sequence of SEQ ID NO: 313. In some embodiments, the first antisense sequence targets a first target region comprising the nucleotide sequence of SEQ ID NO: 314. In some embodiments, the first antisense sequence targets a first target region comprising the nucleotide sequence of SEQ ID NO: 315. In some embodiments, the first antisense sequence targets the first target region comprising the nucleotide sequence of SEQ ID NO: 316. In some embodiments, the second antisense sequence targets a second target region comprising the nucleotide sequence of SEQ ID NO: 313. In some embodiments, the second antisense sequence targets a second target region comprising the nucleotide sequence of SEQ ID NO: 314. In some embodiments, the second antisense sequence targets a second target region comprising the nucleotide sequence of SEQ ID NO: 315. In some embodiments, the second antisense sequence targets a second target region comprising the nucleotide sequence of SEQ ID NO: 316. In some embodiments, the first antisense sequence targets a first target region comprising the nucleotide sequence of SEQ ID NO: 316, and the second antisense sequence targets a second target region comprising the nucleotide sequence of SEQ ID NO: 316. In some embodiments, the first antisense sequence targets a first target region comprising the nucleotide sequence of SEQ ID NO: 316, and the second antisense sequence targets a second target region comprising the nucleotide sequence of SEQ ID NO: 315. In some embodiments, the first antisense sequence targets a first target region comprising the nucleotide sequence of SEQ ID NO: 316, and the second antisense sequence targets a second target region comprising the nucleotide sequence of SEQ ID NO: 314. In some embodiments, the first antisense sequence targets a first target region comprising the nucleotide sequence of SEQ ID NO: 316, and the second antisense sequence targets a second target region comprising the nucleotide sequence of SEQ ID NO: 313. In some embodiments, the first antisense sequence targets a first target region comprising the nucleotide sequence of SEQ ID NO: 315, and the second antisense sequence targets a second target region comprising the nucleotide sequence of SEQ ID NO: 315. In some embodiments, the first antisense sequence targets a first target region comprising the nucleotide sequence of SEQ ID NO: 315, and the second antisense sequence targets a second target region comprising the nucleotide sequence of SEQ ID NO: 314. In some embodiments, the first antisense sequence targets a first target region comprising the nucleotide sequence of SEQ ID NO: 315, and the second antisense sequence targets a second target region comprising the nucleotide sequence of SEQ ID NO: 313. In some embodiments, the first antisense sequence targets a first target region comprising the nucleotide sequence of SEQ ID NO: 314, and the second antisense sequence targets a second target region comprising the nucleotide sequence of SEQ ID NO: 314. In some embodiments, the first antisense sequence targets a first target region comprising the nucleotide sequence of SEQ ID NO: 314, and the second antisense sequence targets a second target region comprising the nucleotide sequence of SEQ ID NO: 313. In some embodiments, the first antisense sequence targets a first target region comprising the nucleotide sequence of SEQ ID NO: 313, and the second antisense sequence targets a second target region comprising the nucleotide sequence of SEQ ID NO: 313.

In some embodiments, an antisense oligonucleotide disclosed herein comprises a first antisense sequence targeting a first target region and a second antisense sequence targeting a second target region. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 313. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 313. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 314. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 314. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 315. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 315. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 316. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 316. In some embodiments, the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO: 313. In some embodiments, the second antisense sequence comprises a region of complementarity of at least 8 (e.g., 8, 9, 10, 11, 12, 13, 14, 15, or more) nucleosides in length to a second target region comprising the nucleotide sequence of SEQ ID NO: 313. In some embodiments, the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO: 314. In some embodiments, the second antisense sequence comprises a region of complementarity of at least 8 (e.g., 8, 9, 10, 11, 12, 13, 14, 15, or more) nucleosides in length to a second target region comprising the nucleotide sequence of SEQ ID NO: 314. In some embodiments, the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO: 315. In some embodiments, the second antisense sequence comprises a region of complementarity of at least 8 (e.g., 8, 9, 10, 11, 12, 13, 14, 15, or more) nucleosides in length to a second target region comprising the nucleotide sequence of SEQ ID NO: 315. In some embodiments, the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO: 316. In some embodiments, the second antisense sequence comprises a region of complementarity of at least 8 (e.g., 8, 9, 10, 11, 12, 13, 14, 15, or more) nucleosides in length to a second target region comprising the nucleotide sequence of SEQ ID NO: 316.

In some embodiments, an antisense oligonucleotide disclosed herein comprises a first antisense sequence targeting a first target region and a second antisense sequence targeting a second target region. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 316 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 316. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 316 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 316. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 316 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 315. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 316 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 315. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 316 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 316 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 316 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 316 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 315 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 315. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 315 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 315. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 315 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 315 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 315 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 315 and the second antisense sequence comprises a region of complementarity of at least 8 (e.g., 8, 9, 10, 11, 12, 13, 14, 15, or more)

nucleosides in length to a second target region comprising the nucleotide sequence of SEQ ID NO 313. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 314 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 314 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 314. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 314 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 314 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 6 (e.g., 6, 7, 8, 9, 10, 11, 12, 13, 14, 15, or more) nucleosides in length to a first target region comprising the nucleotide sequence of SEQ ID NO: 313 and the second antisense sequence comprises a region of complementarity of at least 6 (e.g., 6, 7, 8, 9, 10, 11, 12, 13, 14, 15, or more) nucleosides in length to a second target region comprising the nucleotide sequence of SEQ ID NO 313. In some embodiments, the first antisense sequence comprises a region of complementarity of at least 8 (e.g., 8, 9, 10, 11, 12, 13, 14, 15, or more) nucleosides in length to a first target region comprising the nucleotide sequence of SEQ ID NO: 313 and the second antisense sequence comprises a region of complementarity of at least 8 (e.g., 8, 9, 10, 11, 12, 13, 14, 15, or more) nucleosides in length to a second target region comprising the nucleotide sequence of SEQ ID NO 313.

For the purposes of the present disclosure, a region of complementary need not be 100% complementary to that of its target to be specifically hybridizable or specific for an UNC13A sequence. In some embodiments, the region of complementarity is at least 80%, at least 85%, at least 90%, at least 91%, at least 92%, at least 93%, at least 94%, at least 95%, at least 96%, at least 97%, at least 98%, at least 99% or 100% complementary to a target region in a target sequence. In some embodiments, the target region is a region of consecutive nucleosides in the target sequence. In some embodiments, the region of complementarity comprises a nucleoside sequence that contains no more than 1, 2, 3, 4, or 5 base mismatches compared to the complementary portion of a target sequence. In some embodiments, the region of complementarity comprises a nucleoside sequence that has up to 3 mismatches over 15 nucleosides, or up to 2 mismatches over 10 nucleosides.

In some embodiments, an antisense oligonucleotide disclosed herein comprises a first antisense sequence targeting a first target region and a second antisense sequence targeting a second target region. In some embodiments, the first antisense sequence is 6-15 (e.g., 6, 7, 8, 9, 10, 11, 12, 13, 14, or 15) nucleosides in length. In some embodiments, the second antisense sequence is 6-15 (e.g., 6, 7, 8, 9, 10, 11, 12, 13, 14, or 15) nucleosides in length. In some embodiments, the first antisense sequence is 8-15 (e.g., 8, 9, 10, 11, 12, 13, 14, or 15) nucleosides in length. In some embodiments, the second antisense sequence is 8-15 (e.g., 8, 9, 10, 11, 12, 13, 14, or 15) nucleosides in length. In some embodiments, the first antisense sequence is 10-14 (e.g., 10, 11, 12, 13, or 14) nucleosides in length and the second antisense sequence is 10-14 (e.g., 10, 11, 12, 13, or 14) nucleosides in length. In some embodiments, the first antisense sequence and the second antisense sequence are of the same length. In some embodiments, the first antisense sequence and the second antisense sequence are of different lengths. In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35). In some embodiments, the antisense oligonucleotide is 16-30 (e.g., 16, 17, 18, 19, 20, 21, 22, 23, 24, 25, 26, 27, 28, 29, or 30) nucleosides in length. In some embodiments, the antisense oligonucleotide is 20-28 (e.g., 20, 21, 22, 23, 24, 25, 26, 27, or 28) nucleosides in length.

In some embodiments, an antisense oligonucleotide disclosed herein comprises a first antisense sequence targeting a first target region and a second antisense sequence targeting a second target region. In some embodiments, the first antisense sequence is 6-15 nucleosides (e.g., 6, 7, 8, 9, 10, 11, 12, 13, 14, or 15 nucleosides) in length and comprises a region of complementarity to a first target region comprising the nucleotide sequence of SEQ ID NOS: 313-316, wherein the region of complementarity is at least 6 nucleosides (e.g., at least 6, at least 7, at least 8, at least 9, at least 10, at least 11, at least 12, at least 13, or at least 14 nucleosides) in length. In some embodiments, the first antisense sequence is 8-15 nucleosides (e.g., 8, 9, 10, 11, 12, 13, 14, or 15 nucleosides) in length and comprises a region of complementarity to a first target region comprising the nucleotide sequence of SEQ ID NOS: 313-316, wherein the region of complementarity is at least 8 nucleosides (e.g., at least 8, at least 9, at least 10, at least 11, at least 12, at least 13, or at least 14 nucleosides) in length. In some embodiments, the first antisense sequence is 8-15 nucleosides (e.g., 8, 9, 10, 11, 12, 13, 14, or 15 nucleosides) in length and comprises a region of complementarity to a first target region comprising the nucleotide sequence of SEQ ID NO: 313 or 315, wherein the region of complementarity is at least 8 nucleosides (e.g., at least 8, at least 9, at least 10, at least 11, at least 12, at least 13, or at least 14 nucleosides) in length. In some embodiments, the second antisense sequence is 6-15 nucleosides (e.g., 6, 7, 8, 9, 10, 11, 12, 13, 14, or 15 nucleosides) in length and comprises a region of complementarity to a second target region comprising the nucleotide sequence of SEQ ID NOs: 313-316, wherein the region of complementarity is at least 6 nucleosides (e.g., at least 6, at least 7, at least 8, at least 9, at least 10, at least 11, at least 12, at least 13, or at least 14 nucleosides) in length. In some embodiments, the second antisense sequence is 8-15 nucleosides (e.g., 8, 9, 10, 11, 12, 13, 14, or 15 nucleosides) in length and comprises a region of complementarity to a second target region comprising the nucleotide sequence of SEQ ID NOs: 313-316, wherein the region of complementarity is at least 8 nucleosides (e.g., at least 8, at least 9, at least 10, at least 11, at least 12, at least 13, or at least 14 nucleosides) in length. In some embodiments, the region of complementarity includes 1, 2, 3 or more mismatches. In some embodiments, the second antisense sequence is 8-15 nucleosides (e.g., 8, 9, 10, 11, 12, 13, 14, or 15 nucleosides) in length and comprises a region of complementarity to a second target region comprising the nucleotide sequence of SEQ ID NO: 313 or 315, wherein the region of complementarity is at least 8 nucleosides (e.g., at least 8, at least 9, at least 10, at least 11, at least 12, at least 13, or at least 14 nucleosides) in length. In some embodiments, the region of complementarity includes 1, 2, 3 or more mismatches.

In some embodiments, an antisense oligonucleotide disclosed herein comprises a first antisense sequence targeting a first target region and a second antisense sequence targeting a second target region. In some embodiments, the first antisense sequence is 6-15 nucleosides (e.g., 6, 7, 8, 9, 10, 11, 12, 13, 14, or 15 nucleosides) in length and comprises a region of complementarity of 6, 7, 8, 9, 10, 11, 12, 13, 14, or 15 nucleosides in length to a first target region comprising the nucleotide sequence of SEQ ID NOs: 313-316 and the second antisense sequence of an antisense oligonucleotide disclosed herein is 6-15 nucleosides (e.g., 6, 7, 8, 9, 10, 11, 12, 13, 14, or 15 nucleosides) in length and comprises a region of complementarity of 6, 7, 8, 9, 10, 11, 12, 13, 14, or 15 nucleosides in length to a second target region comprising the nucleotide sequence of SEQ ID NOs: 313-316. In some embodiments, the first antisense sequence is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a first target region comprising the nucleotide sequence of SEQ ID NOs: 313-316 and the second antisense sequence of an antisense oligonucleotide disclosed herein is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a second target region comprising the nucleotide sequence of SEQ ID NOs: 313-316.

In some embodiments, an antisense oligonucleotide disclosed herein comprises a first antisense sequence targeting a first target region and a second antisense sequence targeting a second target region. In some embodiments, the first antisense sequence is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a first target region comprising the nucleotide sequence of SEQ ID NO: 315 and the second antisense sequence is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a second target region comprising the nucleotide sequence of SEQ ID NO: 315.

In some embodiments, an antisense oligonucleotide disclosed herein comprises a first antisense sequence targeting a first target region and a second antisense sequence targeting a second target region. In some embodiments, the first antisense sequence of an antisense oligonucleotide disclosed herein is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a first target region comprising the nucleotide sequence of SEQ ID NO: 315 and the second antisense sequence of an antisense oligonucleotide disclosed herein is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a second target region comprising the nucleotide sequence of SEQ ID NO: 314.

In some embodiments, an antisense oligonucleotide disclosed herein comprises a first antisense sequence targeting a first target region and a second antisense sequence targeting a second target region. In some embodiments, the first antisense sequence of an antisense oligonucleotide disclosed herein is 8-15 nucleosides (e.g., 8, 9, 10, 11, 12, 13, 14, or 15 nucleosides) in length and comprises a region of complementary of 8, 9, 10, 11, 12, 13, 14, or 15 nucleosides in length to a first target region comprising the nucleotide sequence of SEQ ID NO: 315 and the second antisense sequence of an antisense oligonucleotide disclosed herein is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a second target region comprising the nucleotide sequence of SEQ ID NO: 313.

In some embodiments, an antisense oligonucleotide disclosed herein comprises a first antisense sequence targeting a first target region and a second antisense sequence targeting a second target region. In some embodiments, the first antisense sequence of an antisense oligonucleotide disclosed herein is 8-15 nucleosides (e.g., 8, 9, 10, 11, 12, 13, 14, or 15 nucleosides) in length and comprises a region of complementary of 8, 9, 10, 11, 12, 13, 14, or 15 nucleosides in length to a first target region comprising the nucleotide sequence of SEQ ID NO: 313 and the second antisense sequence of an antisense oligonucleotide disclosed herein is 8-15 nucleosides (e.g., 8, 9, 10, 11, 12, 13, 14, or 15 nucleosides) in length and comprises a region of complementarity of 8, 9, 10, 11, 12, 13, 14, or 15 nucleosides in length to a second target region comprising the nucleotide sequence of SEQ ID NO: 313.

Non-limiting examples of the nucleobase sequences of an antisense oligonucleotide described herein, the first antisense sequence and/or the second antisense sequence of an antisense oligonucleotide described herein, are provided in Table 3. Non-limiting examples of the nucleobase sequences of an antisense oligonucleotide described herein, the first antisense sequence and/or the second antisense sequence of an antisense oligonucleotide described herein, are provided in Table 9.

In some embodiments, an antisense oligonucleotide disclosed herein comprises a first antisense sequence and a second antisense sequence. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 191-245. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 246, 247, 274, 288, and 495-515. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 246, 247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC. In some embodiments, the first antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 191-245. In some embodiments, the first antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 246, 247, 274, 288, and 495-515. In some embodiments, the first antisense sequence comprises the nucleobase sequence of any one of SEQ ID NOs: 191-245. In some embodiments, the first antisense sequence comprises the nucleobase sequence of any one of SEQ ID NOs: 246, 247, 274, 288, and 495-515. In some embodiments, the first antisense sequence comprises the nucleobase sequence of any one of AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC. In some embodiments, the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 194, 199, 212, 226, 227, and 246-306. In some embodiments, the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 516-535. In some embodiments, the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 516-535, CAATCAT, GTTCAAT, TTCAATC, TCAATCA, TTTTATC, CTTTTAT, TGTACTC, and TCACCCA. In some embodiments, the second antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 194, 199, 212, 226, 227, and 246-306. In some embodiments, the second antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 516-535. In some embodiments, the second antisense sequence comprises the nucleobase sequence of any one of SEQ ID NOs: 194, 199, 212, 226, 227, and 246-306. In some embodiments, the second antisense sequence comprises the nucleobase sequence of any one of SEQ ID NOs: 516-535. In some embodiments, the second antisense sequence comprises the nucleobase sequence of any one of CAATCAT, GTTCAAT, TTCAATC, TCAATCA, TTTTATC, CTTTTAT, TGTACTC, and TCACCCA.

In some embodiments, an antisense oligonucleotide disclosed herein comprises a first antisense sequence and a second antisense sequence. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 191-245 and the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 194, 199, 212, 226, 227, and 246-306. In some embodiments, the first antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 191-245 and the second antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 194, 199, 212, 226, 227, and 246-306. In some embodiments, the first antisense sequence comprises the nucleobase sequence of any one of SEQ ID NOs: 191-245 and the second antisense sequence comprises the nucleobase sequence of any one of SEQ ID NOs: 194, 199, 212, 226, 227, and 246-306.

In some embodiments, an antisense oligonucleotide disclosed herein comprises a first antisense sequence and a second antisense sequence. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 191-247, 274, 288, and 495-515 and the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 194, 199, 212, 226, 227, 246-306, and 516-535. In some embodiments, an antisense oligonucleotide disclosed herein comprises a first antisense sequence and a second antisense sequence. In some embodiments, the first antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 191-247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC and the second antisense sequence is 6-15 nucleosides (e.g., 6, 7, 8, 9, 10, 11, 12, 13, 14, or 15 nucleosides) in length and comprises at least 6 (e.g., at least 6, at least 7, at least 8, at least 9, at least 10, at least 11, at least 12, at least 13, or at least 14) contiguous nucleobases of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA. In some embodiments, the first antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOS: 191-247, 274, 288, and 495-515 and the second antisense sequence is 8-15 nucleosides (e.g., 8, 9, 10, 11, 12, 13, 14, or 15 nucleosides) in length and comprises at least 8 (e.g., at least 8, at least 9, at least 10, at least 11, at least 12, at least 13, or at least 14) contiguous nucleobases of any one of SEQ ID NOs: 194, 199, 212, 226, 227, 246-306, and 516-535. In some embodiments, the first antisense sequence comprises the nucleobase sequence of any one of SEQ ID NOs: 191-247, 274, 288, 495-515, AGCCACGA, ACGAATC, CGAATCT, GAATCTA, AATCTAC, CAATCAT, GTTCAAT, TTCAATC, TCAATCA, TTTTATC, CTTTTAT, TCACCCA, ACGAATCTA, GCCACGA, GAATCTAC, CGAATCTA, CGAATCTAC, GAATCTACC, TCTACCC, ATCTACC, GTCGCCG, GGGGTCG, GGGTCGC, and GGTCGCC and the second antisense sequence comprises the nucleobase sequence of any one of SEQ ID NOs: 194, 199, 212, 226, 227, 246-306, 516-535, CAATCAT, GTTCAAT, TTCAATC, TCAATCA, TTTTATC, CTTTTAT, TGTACTC, and TCACCCA.

In some embodiments, in any one of the antisense oligonucleotides described herein, the first antisense sequence and second antisense sequence are immediately adjacent (e.g., having no nucleobases between the first antisense sequence and second antisense sequence) to each other. In some embodiments, in any one of the antisense oligonucleotides described herein, one or more nucleobases (e.g., 1, 2, 3, 4, 5, 6, 7, 8, 9, 10, or more) are between the first antisense sequence and second antisense sequence. In some embodiments, the present disclosure provides antisense oligonucleotides in which one or more nucleobases (e.g., 1, 2, 3, 4, 5, 6, 7, 8, 9, 10, or more) at the 3' end of the first antisense sequence is complementary to one or more nucleobases (e.g., 1, 2, 3, 4, 5, 6, 7, 8, 9, 10, or more) at the 3' end of the second target region, and/or one or more nucleobases (e.g., 1, 2, 3, 4, 5, 6, 7, 8, 9, 10, or more) at the 5' end of the second antisense sequence is complementary to one or more nucleobases (e.g., 1, 2, 3, 4, 5, 6, 7, 8, 9, 10, or more) at the 5' end of the first target region.

In some embodiments, any one of the antisense oligonucleotides described herein comprises a spacer between the first antisense sequence and second antisense sequence. In some embodiments, a spacer comprises one or more (1, 2, 3, 4, 5, 6, or more) abasic moieties. In some embodiments, the spacer is a C3 spacer (e.g., a C3 spacer as shown in Table 16). In some embodiments, the spacer is a C6 spacer (e.g., a C5 spacer as shown in Table 16).

In some embodiments, an antisense oligonucleotide disclosed herein comprises a first antisense sequence comprising the nucleobase sequence of SEQ ID NO: 194 and a second antisense sequence comprising the nucleobase sequence of SEQ ID NO: 253, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of SEQ ID NO: 194 and a second antisense sequence comprising the nucleobase sequence of SEQ ID NO: 253, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of SEQ ID NO: 497 and a second antisense sequence comprising the nucleobase sequence of SEQ ID NO: 249, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of SEQ ID NO: 506 and a second antisense sequence comprising the nucleobase sequence of SEQ ID NO: 259, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of SEQ ID NO: 246 and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of SEQ ID NO: 198 and a second antisense sequence comprising the nucleobase sequence of SEQ ID NO: 253, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of GAATCTA and a second antisense sequence comprising the nucleobase sequence of SEQ ID NO: 246, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTA and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of GAATCTA and a second antisense sequence comprising the nucleobase sequence of SEQ ID NO: 534, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTA and a second antisense sequence comprising the nucleobase sequence of SEQ ID NO: 534, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of GAATCTACC and a second antisense sequence comprising the nucleobase sequence of SEQ ID NO: 535, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTACC and a second antisense sequence comprising the nucleobase sequence of SEQ ID NO: 535, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of GAATCTACC and a second antisense sequence comprising the nucleobase sequence of SEQ ID NO: 264, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTACC and a second antisense sequence comprising the nucleobase sequence of SEQ ID NO: 264, wherein the 3' end of the first antisense sequence is linked to the 5' end of the second antisense sequence by a C6 spacer (e.g., a C6 spacer, as shown in Table 16).

In some embodiments, an antisense oligonucleotide disclosed herein comprises a first antisense sequence comprising the nucleobase sequence of GAATCTAC and a second antisense sequence comprising the nucleobase sequence of SEQ ID NO: 264, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTAC and a second antisense sequence comprising the nucleobase sequence of SEQ ID NO: 246, wherein the 3' end of the first antisense sequence is linked to the 5' end of the second antisense sequence by a C3 spacer (e.g., a C3 spacer, as shown in Table 16).

In some embodiments, an antisense oligonucleotide disclosed herein comprises a first antisense sequence comprising the nucleobase sequence of GAATCTAC and a second antisense sequence comprising the nucleobase sequence of SEQ ID NO: 246, wherein the 3' end of the first antisense sequence is linked to the 5' end of the second antisense sequence by a C6 spacer (e.g., a C6 spacer, as shown in Table 16).

In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35) and comprises at least 16 (e.g., 16, 17, 18, 19, 20, 21, 22, 23, 24, 25, 26, 27, 28, 29, or 30) contiguous nucleobases of any one of SEQ ID NOs: 1-190. In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35) and comprises at least 16 (e.g., 16, 17, 18, 19, 20, 21, 22, 23, 24, 25, 26, 27, 28, 29, or 30) contiguous nucleobases of any one of SEQ ID NOs: 338-494. In some embodiments, the antisense oligonucleotide is 16-30 (e.g., 16, 17, 18, 19, 20, 21, 22, 23, 24, 25, 26, 27, 28, 29, or 30) nucleosides in length and comprises at least 16 (e.g., 16, 17, 18, 19, 20, 21, 22, 23, 24, 25, 26, 27, 28, 29, or 30) contiguous nucleobases of any one of SEQ ID NOs: 1-190. In some embodiments, the antisense oligonucleotide is 16-30 (e.g., 16, 17, 18, 19, 20, 21, 22, 23, 24, 25, 26, 27, 28, 29, or 30) nucleosides in length and comprises at least 16 (e.g., 16, 17, 18, 19, 20, 21, 22, 23, 24, 25, 26, 27, 28, 29, or 30) contiguous nucleobases of any one of SEQ ID NOs: 338-494. In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35) and comprises a nucleobase sequence that is at least 80% identical (e.g., at least 80%, 85%, 90%, 95%, 99%, or 100% identical) to the nucleobase sequence of any one of SEQ ID NOS: 1-190. In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35) and comprises a nucleobase sequence that is at least 80% identical (e.g., at least 80%, 85%, 90%, 95%, 99%, or 100% identical) to the nucleobase sequence of any one of SEQ ID NOs: 338-494. In some embodiments, the antisense oligonucleotide is 12-35 (e.g., 12, 13, 14, 15, 16, 17, 18, 19, 20, 21, 22, 23, 24, 25, 26, 27, 28, 29, 30, 31, 32, 33, 34, or 35) and comprises a nucleobase sequence that is at least 80% identical (e.g., at least 80%, 85%, 90%, 95%, 99%, or 100% identical) to the nucleobase sequence of any one of SEQ ID NOs: 1-182, 184-190, 338-434, 442-494. In some embodiments, the antisense oligonucleotide is 16-30 (e.g., 16, 17, 18, 19, 20, 21, 22, 23, 24, 25, 26, 27, 28, 29, or 30) nucleosides in length and comprises a nucleobase sequence that is at least 80% identical (e.g., at least 80%, 85%, 90%, 95%, 99%, or 100% identical) to the nucleobase sequence of any one of SEQ ID NOs: 1-190. In some embodiments, the antisense oligonucleotide is 16-30 (e.g., 16, 17, 18, 19, 20, 21, 22, 23, 24, 25, 26, 27, 28, 29, or 30) nucleosides in length and comprises a nucleobase sequence that is at least 80% identical (e.g., at least 80%, 85%, 90%, 95%, 99%, or 100% identical) to the nucleobase sequence of any one of SEQ ID NOs: 338-494. In some embodiments, the antisense oligonucleotide is 16-30 (e.g., 16, 17, 18, 19, 20, 21, 22, 23, 24, 25, 26, 27, 28, 29, or 30) nucleosides in length and comprises a nucleobase sequence that is at least 80% identical (e.g., at least 80%, 85%, 90%, 95%, 99%, or 100% identical) to the nucleobase sequence of any one of SEQ ID NOs: 1-182, 184-190, 338-434, 442-494.

In some embodiments, an antisense oligonucleotide disclosed herein comprises a first antisense sequence and a second antisense sequence, wherein the first antisense sequence comprises a nucleobase sequence selected from (5'→3'):

```
(i)
                             (SEQ ID NO: 191)
CACGAATCTACCC

(ii)
                             (SEQ ID NO: 192)
CGAATCTACCCAC

(iii)
                             (SEQ ID NO: 198)
CCATCCATCATCC

(iv)
                             (SEQ ID NO: 199)
GCATTTATTCAAC

(v)
                             (SEQ ID NO: 193)
CCACGAATCTACC
```

-continued (vi) (SEQ ID NO: 194)
TGTTCAATCATTC (vii) (SEQ ID NO: 204)
CGAATCTACCCA (viii) (SEQ ID NO: 212)
CGAATCTACC (ix) (SEQ ID NO: 196)
ACGAATCTACCCA (x) (SEQ ID NO: 205)
ACGAATCTACCC (xi) (SEQ ID NO: 222)
TCCATCCATCATC
and (xii) (SEQ ID NO: 233)
CATCCATCTATCC.

In some embodiments, an antisense oligonucleotide disclosed herein comprises a first antisense sequence and a second antisense sequence, wherein the second antisense sequence that comprises a nucleobase sequence selected from (5'→3'):

(i) (SEQ ID NO: 246)
CCATCCATGTACT (ii) (SEQ ID NO: 247)
ATCTGTTCAATCA (iii) (SEQ ID NO: 253)
GGGATAAGAGTTC (iv) (SEQ ID NO: 254)
GGGGATAAGAGTT (v) (SEQ ID NO: 252)
GGATAAGAGTTCT (vi) (SEQ ID NO: 261)
ATCTGTTCAATC (vii) (SEQ ID NO: 271)
ATCCATGTAC (viii) (SEQ ID NO: 276)
CATCTGTTCAATC
and (ix) (SEQ ID NO: 262)
CCATCCATGTAC.

In some embodiments, an antisense oligonucleotide disclosed herein comprising a first antisense sequence at the 5' end of the antisense oligonucleotide and a second antisense sequence at the 3' end of the antisense oligonucleotide, wherein the first antisense sequence comprises a nucleobase sequence selected from (5'→3'):

(i) (SEQ ID NO: 191)
CACGAATCTACCC (ii) (SEQ ID NO: 192)
CGAATCTACCCAC (iii) (SEQ ID NO: 198)
CCATCCATCATCC (iv) (SEQ ID NO: 199)
GCATTTATTCAAC (v) (SEQ ID NO: 193)
CCACGAATCTACC (vi) (SEQ ID NO: 194)
TGTTCAATCATTC (vii) (SEQ ID NO: 204)
CGAATCTACCCA (viii) (SEQ ID NO: 212)
CGAATCTACC (ix) (SEQ ID NO: 196)
ACGAATCTACCCA (x) (SEQ ID NO: 205)
ACGAATCTACCC (xi) (SEQ ID NO: 222)
TCCATCCATCATC
and (xii) (SEQ ID NO: 233)
CATCCATCTATCC;

wherein the second antisense sequence comprises a nucleobase sequence selected from (5'→3'):

(i) (SEQ ID NO: 245)
CCATCCATGTACT (ii) (SEQ ID NO: 247)
ATCTGTTCAATCA (iii) (SEQ ID NO: 253)
GGGATAAGAGTTC (iv) (SEQ ID NO: 254)
GGGGATAAGAGTT (v) (SEQ ID NO: 252)
GGATAAGAGTTCT (vi) (SEQ ID NO: 261)
ATCTGTTCAATC (vii) (SEQ ID NO: 271)
ATCCATGTAC -continued (viii)
(SEQ ID NO: 276)
CATCTGTTCAATC
and (ix)
(SEQ ID NO: 262)
CCATCCATGTAC.

In some embodiments, an antisense oligonucleotide disclosed herein comprises a nucleobase sequence selected from (5'→3'):

(i)
(SEQ ID NO: 1)
CACGAATCTACCCCCATCCATGTACT (ii)
(SEQ ID NO: 2)
CGAATCTACCCACATCTGTTCAATCA (iii)
(SEQ ID NO: 16)
CCATCCATCATCCGGGATAAGAGTTC (iv)
(SEQ ID NO: 17)
GCATTTATTCAACGGGGATAAGAGTT (v)
(SEQ ID NO: 8)
CCACGAATCTACCGGATAAGAGTTCT (vi)
(SEQ ID NO: 9)
TGTTCAATCATTCGGGATAAGAGTTC (vii)
(SEQ ID NO: 14)
CCACGAATCTACCGGGATAAGAGTTC (viii)
(SEQ ID NO: 36)
CGAATCTACCCAATCTGTTCAATC (ix)
(SEQ ID NO: 82)
CGAATCTACCATCCATGTAC -continued (x)
(SEQ ID NO: 93)
ACGAATCTACCCACATCTGTTCAATC (xi)
(SEQ ID NO: 37)
ACGAATCTACCCCCATCCATGTAC (xii)
(SEQ ID NO: 121)
TCCATCCATCATCGGGATAAGAGTTC
and (xiii)
(SEQ ID NO: 159)
CATCCATCTATCCGGGATAAGAGTTC It is to be understood that, for the purposes of the present disclosure, an antisense oligonucleotide comprising nucleobase sequences (e.g., nucleobase sequences of the antisense oligonucleotide, first antisense sequence, and second antisense sequence) of the antisense oligonucleotides listed in Table 3 encompasses antisense oligonucleotides comprising such nucleobase sequences and comprising no chemical modifications (e.g., modified nucleosides and/or modified internucleoside linkages), and an antisense oligonucleotides comprising such nucleobase sequences and comprising chemical modifications (e.g., one or more modified nucleosides and/or one or more modified internucleoside linkages; e.g., those provided in Table 5), and encompasses such modified or unmodified antisense oligonucleotides unconjugated or conjugated to a targeting moiety.

It is to be understood that, for the purposes of the present disclosure, an antisense oligonucleotide comprising nucleobase sequences (e.g., nucleobase sequences of the antisense oligonucleotide, first antisense sequence, and second antisense sequence) of the antisense oligonucleotides listed in Table 9 encompasses antisense oligonucleotides comprising such nucleobase sequences and comprising no chemical modifications (e.g., modified nucleosides and/or modified internucleoside linkages), and an antisense oligonucleotides comprising such nucleobase sequences and comprising chemical modifications (e.g., one or more modified nucleosides and/or one or more modified internucleoside linkages; e.g., those provided in Table 11), and encompasses such modified or unmodified antisense oligonucleotides unconjugated or conjugated to a targeting moiety.

TABLE 3

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 1 | CACGAATCTACCCCCATCCATGTACT | 1 | CACGAATCTACCC | 191 | CCATCCATGTACT | 246 |
| 2 | CGAATCTACCCACATCTGTTCAATCA | 2 | CGAATCTACCCAC | 192 | ATCTGTTCAATCA | 247 |
| 3 | CACGAATCTACCCCATCCATGTACTC | 3 | CACGAATCTACCC | 191 | CATCCATGTACTC | 248 |
| 4 | CGAATCTACCCACGAGTTCTTTCCAG | 4 | CGAATCTACCCAC | 192 | GAGTTCTTTCCAG | 249 |
| 5 | CGAATCTACCCACTAAGAGTTCTTTC | 5 | CGAATCTACCCAC | 192 | TAAGAGTTCTTTC | 250 |
| 6 | CCACGAATCTACCGATAAGAGTTCTT | 6 | CCACGAATCTACC | 193 | GATAAGAGTTCTT | 251 |
| 7 | CACGAATCTACCCGGATAAGAGTTCT | 7 | CACGAATCTACCC | 191 | GGATAAGAGTTCT | 252 |
| 8 | CCACGAATCTACCGGATAAGAGTTCT | 8 | CCACGAATCTACC | 193 | GGATAAGAGTTCT | 252 |
| 9 | TGTTCAATCATTCGGGATAAGAGTTC | 9 | TGTTCAATCATTC | 194 | GGGATAAGAGTTC | 253 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 10 | GAATCTACCCACCGGGATAAGAGTTC | 10 | GAATCTACCCACC | 195 | GGGATAAGAGTTC | 253 |
| 11 | CGAATCTACCCACGGGATAAGAGTTC | 11 | CGAATCTACCCAC | 192 | GGGATAAGAGTTC | 253 |
| 12 | ACGAATCTACCCAGGGATAAGAGTTC | 12 | ACGAATCTACCCA | 196 | GGGATAAGAGTTC | 253 |
| 13 | CACGAATCTACCCGGGATAAGAGTTC | 13 | CACGAATCTACCC | 191 | GGGATAAGAGTTC | 253 |
| 14 | CCACGAATCTACCGGGATAAGAGTTC | 14 | CCACGAATCTACC | 193 | GGGATAAGAGTTC | 253 |
| 15 | CTAGCCACGAATCGGGATAAGAGTTC | 15 | CTAGCCACGAATC | 197 | GGGATAAGAGTTC | 253 |
| 16 | CCATCCATCATCCGGGATAAGAGTTC | 16 | CCATCCATCATCC | 198 | GGGATAAGAGTTC | 253 |
| 17 | GCATTTATTCAACGGGGATAAGAGTT | 17 | GCATTTATTCAAC | 199 | GGGGATAAGAGTT | 254 |
| 18 | CCACCAACTCATCGGGGATAAGAGTT | 18 | CCACCAACTCATC | 200 | GGGGATAAGAGTT | 254 |
| 19 | GAATCTACCCACCGGGGATAAGAGTT | 19 | GAATCTACCCACC | 195 | GGGGATAAGAGTT | 254 |
| 20 | CGAATCTACCCACGGGGATAAGAGTT | 20 | CGAATCTACCCAC | 192 | GGGGATAAGAGTT | 254 |
| 21 | CACGAATCTACCCGGGGATAAGAGTT | 21 | CACGAATCTACCC | 191 | GGGGATAAGAGTT | 254 |
| 22 | CCACGAATCTACCGGGGATAAGAGTT | 22 | CCACGAATCTACC | 193 | GGGGATAAGAGTT | 254 |
| 23 | GCCACGAATCTACGGGGATAAGAGTT | 23 | GCCACGAATCTAC | 201 | GGGGATAAGAGTT | 254 |
| 24 | CGAATCTACCCACCCTGGGGATAAGA | 24 | CGAATCTACCCAC | 192 | CCTGGGGATAAGA | 255 |
| 25 | ACGAATCTACCCATCCTGGGGATAAG | 25 | ACGAATCTACCCA | 196 | TCCTGGGGATAAG | 256 |
| 26 | CGAATCTACCCACGTTCCTGGGGATA | 26 | CGAATCTACCCAC | 192 | GTTCCTGGGGATA | 257 |
| 27 | CACGAATCTACCCGTTCCTGGGGATA | 27 | CACGAATCTACCC | 191 | GTTCCTGGGGATA | 257 |
| 28 | CTAGCCACGAATCGTTCCTGGGGATA | 28 | CTAGCCACGAATC | 197 | GTTCCTGGGGATA | 257 |
| 29 | CGAATCTACCCACTAGTTCCTGGGGA | 29 | CGAATCTACCCAC | 192 | TAGTTCCTGGGGA | 258 |
| 30 | CTAGCCACGAATCTAGTTCCTGGGGA | 30 | CTAGCCACGAATC | 197 | TAGTTCCTGGGGA | 258 |
| 31 | ACGAATCTACCCACTAGTTCCTGGGG | 31 | ACGAATCTACCCA | 196 | CTAGTTCCTGGGG | 259 |
| 32 | ATCTAGCCACGAACTAGTTCCTGGGG | 32 | ATCTAGCCACGAA | 202 | CTAGTTCCTGGGG | 259 |
| 33 | GAATCTACCCACTCTGTTCAATCA | 33 | GAATCTACCCAC | 203 | TCTGTTCAATCA | 260 |
| 34 | CGAATCTACCCATCTGTTCAATCA | 34 | CGAATCTACCCA | 204 | TCTGTTCAATCA | 260 |
| 35 | GAATCTACCCACATCTGTTCAATC | 35 | GAATCTACCCAC | 203 | ATCTGTTCAATC | 261 |
| 36 | CGAATCTACCCAATCTGTTCAATC | 36 | CGAATCTACCCA | 204 | ATCTGTTCAATC | 261 |
| 37 | GAATCTACCCACTCTGTTCAATCA | 33 | GAATCTACCCAC | 203 | TCTGTTCAATCA | 260 |
| 38 | CGAATCTACCCATCTGTTCAATCA | 34 | CGAATCTACCCA | 204 | TCTGTTCAATCA | 260 |
| 39 | GAATCTACCCACATCTGTTCAATC | 35 | GAATCTACCCAC | 203 | ATCTGTTCAATC | 261 |
| 40 | CGAATCTACCCAATCTGTTCAATC | 36 | CGAATCTACCCA | 204 | ATCTGTTCAATC | 261 |
| 41 | CACGAATCTACCCCCATCCATGTACT | 1 | CACGAATCTACCC | 191 | CCATCCATGTACT | 246 |
| 42 | CACGAATCTACCCCATCCATGTACTC | 3 | CACGAATCTACCC | 191 | CATCCATGTACTC | 248 |
| 43 | CCATCCATCATCCGGGATAAGAGTTC | 16 | CCATCCATCATCC | 198 | GGGATAAGAGTTC | 253 |
| 44 | TGTTCAATCATTCGGGATAAGAGTTC | 9 | TGTTCAATCATTC | 194 | GGGATAAGAGTTC | 253 |
| 45 | CACGAATCTACCCCCATCCATGTACT | 1 | CACGAATCTACCC | 191 | CCATCCATGTACT | 246 |
| 46 | CACGAATCTACCCCATCCATGTACTC | 3 | CACGAATCTACCC | 191 | CATCCATGTACTC | 248 |
| 47 | CCATCCATCATCCGGGATAAGAGTTC | 16 | CCATCCATCATCC | 198 | GGGATAAGAGTTC | 253 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 48 | TGTTCAATCATTCGGGATAAGAGTTC | 9 | TGTTCAATCATTC | 194 | GGGATAAGAGTTC | 253 |
| 49 | CACGAATCTACCCCCATCCATGTACT | 1 | CACGAATCTACCC | 191 | CCATCCATGTACT | 246 |
| 50 | CACGAATCTACCCCATCCATGTACTC | 3 | CACGAATCTACCC | 191 | CATCCATGTACTC | 248 |
| 51 | CCATCCATCATCCGGGATAAGAGTTC | 16 | CCATCCATCATCC | 198 | GGGATAAGAGTTC | 253 |
| 52 | TGTTCAATCATTCGGGATAAGAGTTC | 9 | TGTTCAATCATTC | 194 | GGGATAAGAGTTC | 253 |
| 53 | CACGAATCTACCCCCATCCATGTACT | 1 | CACGAATCTACCC | 191 | CCATCCATGTACT | 246 |
| 54 | CACGAATCTACCCCATCCATGTACTC | 3 | CACGAATCTACCC | 191 | CATCCATGTACTC | 248 |
| 55 | CCATCCATCATCCGGGATAAGAGTTC | 16 | CCATCCATCATCC | 198 | GGGATAAGAGTTC | 253 |
| 56 | TGTTCAATCATTCGGGATAAGAGTTC | 9 | TGTTCAATCATTC | 194 | GGGATAAGAGTTC | 253 |
| 57 | CACGAATCTACCCCCATCCATGTACT | 1 | CACGAATCTACCC | 191 | CCATCCATGTACT | 246 |
| 58 | CACGAATCTACCCCATCCATGTACTC | 3 | CACGAATCTACCC | 191 | CATCCATGTACTC | 248 |
| 59 | CCATCCATCATCCGGGATAAGAGTTC | 16 | CCATCCATCATCC | 198 | GGGATAAGAGTTC | 253 |
| 60 | TGTTCAATCATTCGGGATAAGAGTTC | 9 | TGTTCAATCATTC | 194 | GGGATAAGAGTTC | 253 |
| 61 | CACGAATCTACCCCCATCCATGTACT | 1 | CACGAATCTACCC | 191 | CCATCCATGTACT | 246 |
| 62 | CACGAATCTACCCCATCCATGTACTC | 3 | CACGAATCTACCC | 191 | CATCCATGTACTC | 248 |
| 63 | CCATCCATCATCCGGGATAAGAGTTC | 16 | CCATCCATCATCC | 198 | GGGATAAGAGTTC | 253 |
| 64 | TGTTCAATCATTCGGGATAAGAGTTC | 9 | TGTTCAATCATTC | 194 | GGGATAAGAGTTC | 253 |
| 65 | CACGAATCTACCCCCATCCATGTACT | 1 | CACGAATCTACCC | 191 | CCATCCATGTACT | 246 |
| 66 | CACGAATCTACCCCATCCATGTACTC | 3 | CACGAATCTACCC | 191 | CATCCATGTACTC | 248 |
| 67 | CCATCCATCATCCGGGATAAGAGTTC | 16 | CCATCCATCATCC | 198 | GGGATAAGAGTTC | 253 |
| 68 | TGTTCAATCATTCGGGATAAGAGTTC | 9 | TGTTCAATCATTC | 194 | GGGATAAGAGTTC | 253 |
| 69 | CACGAATCTACCCCCATCCATGTACT | 1 | CACGAATCTACCC | 191 | CCATCCATGTACT | 246 |
| 70 | CACGAATCTACCCCATCCATGTACTC | 3 | CACGAATCTACCC | 191 | CATCCATGTACTC | 248 |
| 71 | CCATCCATCATCCGGGATAAGAGTTC | 16 | CCATCCATCATCC | 198 | GGGATAAGAGTTC | 253 |
| 72 | TGTTCAATCATTCGGGATAAGAGTTC | 9 | TGTTCAATCATTC | 194 | GGGATAAGAGTTC | 253 |
| 73 | CACGAATCTACCCCCATCCATGTACT | 1 | CACGAATCTACCC | 191 | CCATCCATGTACT | 246 |
| 74 | CACGAATCTACCCCATCCATGTACTC | 3 | CACGAATCTACCC | 191 | CATCCATGTACTC | 248 |
| 75 | CCATCCATCATCCGGGATAAGAGTTC | 16 | CCATCCATCATCC | 198 | GGGATAAGAGTTC | 253 |
| 76 | TGTTCAATCATTCGGGATAAGAGTTC | 9 | TGTTCAATCATTC | 194 | GGGATAAGAGTTC | 253 |
| 77 | CGAATCTACCCACATCTGTTCAATCA | 2 | CGAATCTACCCAC | 192 | ATCTGTTCAATCA | 247 |
| 78 | CGAATCTACCCACATCTGTTCAATCA | 2 | CGAATCTACCCAC | 192 | ATCTGTTCAATCA | 247 |
| 79 | CGAATCTACCCACATCTGTTCAATCA | 2 | CGAATCTACCCAC | 192 | ATCTGTTCAATCA | 247 |
| 80 | ACGAATCTACCCCCATCCATGTAC | 37 | ACGAATCTACCC | 205 | CCATCCATGTAC | 262 |
| 81 | CACGAATCTACCCCATCCATGTACT | 38 | CACGAATCTACC | 206 | CCATCCATGTACT | 246 |
| 82 | ACGAATCTACCCCCATCCATGTACT | 39 | ACGAATCTACCC | 205 | CCATCCATGTACT | 246 |
| 83 | CACGAATCTACCCCCATCCATGTAC | 40 | CACGAATCTACCC | 191 | CCATCCATGTAC | 262 |
| 84 | CACGAATCTACCCTCCATCCATGTACT | 41 | CACGAATCTACCC | 191 | TCCATCCATGTACT | 263 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 85 | CACGAATCTACCCACCATCCATGTACT | 42 | CACGAATCTACCCA | 207 | CCATCCATGTACT | 246 |
| 86 | ACGAATCTACCCCATCCATGTACT | 43 | ACGAATCTACCC | 205 | CATCCATGTACT | 264 |
| 87 | CACGAATCTACCCATCCATGTACTC | 44 | CACGAATCTACC | 206 | CATCCATGTACTC | 248 |
| 88 | ACGAATCTACCCCATCCATGTACTC | 45 | ACGAATCTACCC | 205 | CATCCATGTACTC | 248 |
| 89 | CACGAATCTACCCCATCCATGTACTCA | 46 | CACGAATCTACCC | 191 | CATCCATGTACTCA | 265 |
| 90 | CCATCCATCATCGGGATAAGAGTT | 47 | CCATCCATCATC | 208 | GGGATAAGAGTT | 266 |
| 91 | CCATCCATCATCGGATAAGAGTTC | 48 | CCATCCATCATC | 208 | GGATAAGAGTTC | 267 |
| 92 | CATCCATCATCCGGGATAAGAGTT | 49 | CATCCATCATCC | 209 | GGGATAAGAGTT | 266 |
| 93 | CATCCATCATCCGGATAAGAGTTC | 50 | CATCCATCATCC | 209 | GGATAAGAGTTC | 267 |
| 94 | CCATCCATCATCGGGATAAGAGTTC | 51 | CCATCCATCATC | 208 | GGGATAAGAGTTC | 253 |
| 95 | CATCCATCATCCGGGATAAGAGTTC | 52 | CATCCATCATCC | 209 | GGGATAAGAGTTC | 253 |
| 96 | CCATCCATCATCCGGGATAAGAGTT | 53 | CCATCCATCATCC | 198 | GGGATAAGAGTT | 266 |
| 97 | CCATCCATCATCCGGATAAGAGTTC | 54 | CCATCCATCATCC | 198 | GGATAAGAGTTC | 267 |
| 98 | CCATCCATCATCCGGGGATAAGAGTTC | 55 | CCATCCATCATCC | 198 | GGGGATAAGAGTTC | 268 |
| 99 | CCATCCATCATCCGGGATAAGAGTTCT | 56 | CCATCCATCATCC | 198 | GGGATAAGAGTTCT | 269 |
| 100 | TCCATCCATCATCCGGGATAAGAGTTC | 57 | TCCATCCATCATCC | 210 | GGGATAAGAGTTC | 253 |
| 101 | GTTCAATCATTCGGGATAAGAGTT | 58 | GTTCAATCATTC | 211 | GGGATAAGAGTT | 266 |
| 102 | GTTCAATCATTCGGATAAGAGTTC | 59 | GTTCAATCATTC | 211 | GGATAAGAGTTC | 267 |
| 103 | GTTCAATCATTCGGGATAAGAGTTC | 60 | GTTCAATCATTC | 211 | GGGATAAGAGTTC | 253 |
| 104 | TGTTCAATCATTCGGATAAGAGTTC | 61 | TGTTCAATCATTC | 194 | GGATAAGAGTTC | 267 |
| 105 | TGTTCAATCATTCGGGATAAGAGTTCT | 62 | TGTTCAATCATTC | 194 | GGGATAAGAGTTCT | 269 |
| 106 | GAATCTACCCACATCTGTTCAATCA | 63 | GAATCTACCCAC | 203 | ATCTGTTCAATCA | 247 |
| 107 | CGAATCTACCCACATCTGTTCAATC | 64 | CGAATCTACCCAC | 192 | ATCTGTTCAATC | 261 |
| 108 | CGAATCTACCCACCATCTGTTCAATCA | 65 | CGAATCTACCCAC | 192 | CATCTGTTCAATCA | 270 |
| 109 | CACGAATCTACCCCCCATCCATGTACT | 66 | CACGAATCTACCC | 191 | CCATCCATGTACT | 246 |
| 110 | CACGAATCTACCCGCCATCCATGTACT | 67 | CACGAATCTACCC | 191 | CCATCCATGTACT | 246 |
| 111 | CACGAATCTACCCTCATCCATGTACTC | 68 | CACGAATCTACCC | 191 | CATCCATGTACTC | 248 |
| 112 | CACGAATCTACCCGCATCCATGTACTC | 69 | CACGAATCTACCC | 191 | CATCCATGTACTC | 248 |
| 113 | TGTTCAATCATTCCGGGATAAGAGTTC | 70 | TGTTCAATCATTC | 194 | GGGATAAGAGTTC | 253 |
| 114 | CCATCCATCATCCCGGGATAAGAGTTC | 71 | CCATCCATCATCC | 198 | GGGATAAGAGTTC | 253 |
| 115 | CACGAATCTACCCCACCATCCATGTACT | 72 | CACGAATCTACCC | 191 | CCATCCATGTACT | 246 |
| 116 | CACGAATCTACCCTCCCATCCATGTACT | 73 | CACGAATCTACCC | 191 | CCATCCATGTACT | 246 |
| 117 | CACGAATCTACCCCCCCATCCATGTACT | 74 | CACGAATCTACCC | 191 | CCATCCATGTACT | 246 |
| 118 | CACGAATCTACCCCTCATCCATGTACTC | 75 | CACGAATCTACCC | 191 | CATCCATGTACTC | 248 |
| 119 | CACGAATCTACCCTTCATCCATGTACTC | 76 | CACGAATCTACCC | 191 | CATCCATGTACTC | 248 |
| 120 | TGTTCAATCATTCCAGGGATAAGAGTTC | 77 | TGTTCAATCATTC | 194 | GGGATAAGAGTTC | 253 |
| 121 | TGTTCAATCATTCCTGGGATAAGAGTTC | 78 | TGTTCAATCATTC | 194 | GGGATAAGAGTTC | 253 |
| 122 | CCATCCATCATCCCAGGGATAAGAGTTC | 79 | CCATCCATCATCC | 198 | GGGATAAGAGTTC | 253 |

TABLE 3-continued

| Nucleobase sequences of antisense oligonucleotides provided herein | | | | | | |
|---|---|---|---|---|---|---|
| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
| 123 | CCATCCATCATCCTCGGGATAAGAGTTC | 80 | CCATCCATCATCC | 198 | GGGATAAGAGTTC | 253 |
| 124 | CCATCCATCATCCTTGGGATAAGAGTTC | 81 | CCATCCATCATCC | 198 | GGGATAAGAGTTC | 253 |
| 125 | ACGAATCTACCCCCATCCATGTAC | 37 | ACGAATCTACCC | 205 | CCATCCATGTAC | 262 |
| 126 | ACGAATCTACCCCATCCATGTACT | 43 | ACGAATCTACCC | 205 | CATCCATGTACT | 264 |
| 127 | CCATCCATCATCGGGATAAGAGTT | 47 | CCATCCATCATC | 208 | GGGATAAGAGTT | 266 |
| 128 | CCATCCATCATCGGATAAGAGTTC | 48 | CCATCCATCATC | 208 | GGATAAGAGTTC | 267 |
| 129 | CATCCATCATCCGGGATAAGAGTT | 49 | CATCCATCATCC | 209 | GGGATAAGAGTT | 266 |
| 130 | CATCCATCATCCGGATAAGAGTTC | 50 | CATCCATCATCC | 209 | GGATAAGAGTTC | 267 |
| 131 | GTTCAATCATTCGGGATAAGAGTT | 58 | GTTCAATCATTC | 211 | GGGATAAGAGTT | 266 |
| 132 | GTTCAATCATTCGGATAAGAGTTC | 59 | GTTCAATCATTC | 211 | GGATAAGAGTTC | 267 |
| 133 | CGAATCTACCCATCTGTTCAATCA | 34 | CGAATCTACCCA | 204 | TCTGTTCAATCA | 260 |
| 134 | CGAATCTACCCAATCTGTTCAATC | 36 | CGAATCTACCCA | 204 | ATCTGTTCAATC | 261 |
| 135 | ACGAATCTACCCCCATCCATGTAC | 37 | ACGAATCTACCC | 205 | CCATCCATGTAC | 262 |
| 136 | ACGAATCTACCCCATCCATGTACT | 43 | ACGAATCTACCC | 205 | CATCCATGTACT | 264 |
| 137 | CCATCCATCATCGGGATAAGAGTT | 47 | CCATCCATCATC | 208 | GGGATAAGAGTT | 266 |
| 138 | CCATCCATCATCGGATAAGAGTTC | 48 | CCATCCATCATC | 208 | GGATAAGAGTTC | 267 |
| 139 | CATCCATCATCCGGGATAAGAGTT | 49 | CATCCATCATCC | 209 | GGGATAAGAGTT | 266 |
| 140 | CATCCATCATCCGGATAAGAGTTC | 50 | CATCCATCATCC | 209 | GGATAAGAGTTC | 267 |
| 141 | GTTCAATCATTCGGGATAAGAGTT | 58 | GTTCAATCATTC | 211 | GGGATAAGAGTT | 266 |
| 142 | GTTCAATCATTCGGATAAGAGTTC | 59 | GTTCAATCATTC | 211 | GGATAAGAGTTC | 267 |
| 143 | CGAATCTACCCATCTGTTCAATCA | 34 | CGAATCTACCCA | 204 | TCTGTTCAATCA | 260 |
| 144 | CGAATCTACCCAATCTGTTCAATC | 36 | CGAATCTACCCA | 204 | ATCTGTTCAATC | 261 |
| 145 | CGAATCTACCATCCATGTAC | 82 | CGAATCTACC | 212 | ATCCATGTAC | 271 |
| 146 | CGAATCTACCCACATCTGTTCAATCA | 2 | CGAATCTACCCAC | 192 | ATCTGTTCAATCA | 247 |
| 147 | CGAATCTACCCACATCTGTTCAATCA | 2 | CGAATCTACCCAC | 192 | ATCTGTTCAATCA | 247 |
| 148 | CGAATCTACCCACATCTGTTCAATCA | 2 | CGAATCTACCCAC | 192 | ATCTGTTCAATCA | 247 |
| 149 | CGAATCTACCCACATCTGTTCAATCA | 2 | CGAATCTACCCAC | 192 | ATCTGTTCAATCA | 247 |
| 150 | CGAATCTACCCACATCTGTTCAATCA | 2 | CGAATCTACCCAC | 192 | ATCTGTTCAATCA | 247 |
| 151 | CGAATCTACCCACATCTGTTCAATCA | 2 | CGAATCTACCCAC | 192 | ATCTGTTCAATCA | 247 |
| 152 | CGAATCTACCCACATCTGTTCAATCA | 2 | CGAATCTACCCAC | 192 | ATCTGTTCAATCA | 247 |
| 153 | CGAATCTACCCACATCTGTTCAATCA | 2 | CGAATCTACCCAC | 192 | ATCTGTTCAATCA | 247 |
| 154 | AATCTACCCACCTGTTCAATCA | 83 | AATCTACCCAC | 213 | CTGTTCAATCA | 272 |
| 155 | AATCTACCCACATCTGTTCAAT | 84 | AATCTACCCAC | 213 | ATCTGTTCAAT | 273 |
| 156 | CGAATCTACCCCTGTTCAATCA | 85 | CGAATCTACCC | 214 | CTGTTCAATCA | 272 |
| 157 | CGAATCTACCCATCTGTTCAAT | 86 | CGAATCTACCC | 214 | ATCTGTTCAAT | 273 |
| 158 | ACGAATCTACCCAATCTGTTCAATCA | 87 | ACGAATCTACCCA | 196 | ATCTGTTCAATCA | 247 |
| 159 | CACGAATCTACCCATCTGTTCAATCA | 88 | CACGAATCTACCC | 191 | ATCTGTTCAATCA | 247 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 160 | GAATCTACCCACCATCTGTTCAATCA | 89 | GAATCTACCCACC | 195 | ATCTGTTCAATCA | 247 |
| 161 | AATCTACCCACCAATCTGTTCAATCA | 90 | AATCTACCCACCA | 215 | ATCTGTTCAATCA | 247 |
| 162 | CGAATCTACCCACTCTGTTCAATCAT | 91 | CGAATCTACCCAC | 192 | TCTGTTCAATCAT | 274 |
| 163 | CGAATCTACCCACTCATCTGTTCAAT | 92 | CGAATCTACCCAC | 192 | TCATCTGTTCAAT | 275 |
| 164 | ACGAATCTACCCACATCTGTTCAATC | 93 | ACGAATCTACCCA | 196 | CATCTGTTCAATC | 276 |
| 165 | GAATCTACCCACCCATCTGTTCAATC | 94 | GAATCTACCCACC | 195 | CATCTGTTCAATC | 276 |
| 166 | ACGAATCTACCCATCTGTTCAATCAT | 95 | ACGAATCTACCCA | 196 | TCTGTTCAATCAT | 274 |
| 167 | GAATCTACCCACCTCTGTTCAATCAT | 96 | GAATCTACCCACC | 195 | TCTGTTCAATCAT | 274 |
| 168 | CCACGAATCTACCTCAATCATTCATT | 97 | CCACGAATCTACC | 193 | TCAATCATTCATT | 277 |
| 169 | CGAATCTACCCACCTCTGTTCAATCA | 98 | CGAATCTACCCACC | 216 | TCTGTTCAATCA | 260 |
| 170 | ACGAATCTACCCACTCTGTTCAATCA | 99 | ACGAATCTACCCAC | 217 | TCTGTTCAATCA | 260 |
| 171 | CGAATCTACCCAATCTGTTCAATCAT | 100 | CGAATCTACCCA | 204 | ATCTGTTCAATCAT | 278 |
| 172 | GAATCTACCCACATCTGTTCAATCAT | 101 | GAATCTACCCAC | 203 | ATCTGTTCAATCAT | 278 |
| 173 | AATCTACCCACCTGTTCAATCA | 83 | AATCTACCCAC | 213 | CTGTTCAATCA | 272 |
| 174 | AATCTACCCACATCTGTTCAAT | 84 | AATCTACCCAC | 213 | ATCTGTTCAAT | 273 |
| 175 | AATCTACCCACTCTGTTCAATC | 102 | AATCTACCCAC | 213 | TCTGTTCAATC | 279 |
| 176 | CGAATCTACCCCTGTTCAATCA | 85 | CGAATCTACCC | 214 | CTGTTCAATCA | 272 |
| 177 | CGAATCTACCCATCTGTTCAAT | 86 | CGAATCTACCC | 214 | ATCTGTTCAAT | 273 |
| 178 | CGAATCTACCCTCTGTTCAATC | 103 | CGAATCTACCC | 214 | TCTGTTCAATC | 279 |
| 179 | GAATCTACCCACTGTTCAATCA | 104 | GAATCTACCCA | 218 | CTGTTCAATCA | 272 |
| 180 | GAATCTACCCAATCTGTTCAAT | 105 | GAATCTACCCA | 218 | ATCTGTTCAAT | 273 |
| 181 | GAATCTACCCATCTGTTCAATC | 106 | GAATCTACCCA | 218 | TCTGTTCAATC | 279 |
| 182 | AATCTACCCACTCTGTTCAATC | 102 | AATCTACCCAC | 213 | TCTGTTCAATC | 279 |
| 183 | CGAATCTACCCTCTGTTCAATC | 103 | CGAATCTACCC | 214 | TCTGTTCAATC | 279 |
| 184 | GAATCTACCCACTGTTCAATCA | 104 | GAATCTACCCA | 218 | CTGTTCAATCA | 272 |
| 185 | GAATCTACCCAATCTGTTCAAT | 105 | GAATCTACCCA | 218 | ATCTGTTCAAT | 273 |
| 186 | GAATCTACCCATCTGTTCAATC | 106 | GAATCTACCCA | 218 | TCTGTTCAATC | 279 |
| 187 | GAATCTACCCATCTGTTCAATC | 106 | GAATCTACCCA | 218 | TCTGTTCAATC | 279 |
| 188 | GAATCTACCCATCTGTTCAATC | 106 | GAATCTACCCA | 218 | TCTGTTCAATC | 279 |
| 189 | GAATCTACCCATCTGTTCAATC | 106 | GAATCTACCCA | 218 | TCTGTTCAATC | 279 |
| 190 | GAATCTACCCATCTGTTCAATC | 106 | GAATCTACCCA | 218 | TCTGTTCAATC | 279 |
| 191 | GAATCTACCCATCTGTTCAATC | 106 | GAATCTACCCA | 218 | TCTGTTCAATC | 279 |
| 192 | CGAATCTACCCAATCTGTTCAATC | 36 | CGAATCTACCCA | 204 | ATCTGTTCAATC | 261 |
| 193 | CGAATCTACCCAATCTGTTCAATC | 36 | CGAATCTACCCA | 204 | ATCTGTTCAATC | 261 |
| 194 | CGAATCTACCCAATCTGTTCAATC | 36 | CGAATCTACCCA | 204 | ATCTGTTCAATC | 261 |
| 195 | CGAATCTACCCACTCATCTGTTCAAT | 92 | CGAATCTACCCAC | 192 | TCATCTGTTCAAT | 275 |
| 196 | CGAATCTACCCACTCATCTGTTCAAT | 92 | CGAATCTACCCAC | 192 | TCATCTGTTCAAT | 275 |
| 197 | ACGAATCTACCCACATCTGTTCAATC | 93 | ACGAATCTACCCA | 196 | CATCTGTTCAATC | 276 |

TABLE 3-continued

| Nucleobase sequences of antisense oligonucleotides provided herein | | | | | | |
|---|---|---|---|---|---|---|
| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
| 198 | ACGAATCTACCCACATCTGTTCAATC | 93 | ACGAATCTACCCA | 196 | CATCTGTTCAATC | 276 |
| 199 | CAAATCTACCCACATCTGTTCAATCA | 107 | CAAATCTACCCAC | 219 | ATCTGTTCAATCA | 247 |
| 200 | CGAATCTACCCACATCTATTCAATCA | 108 | CGAATCTACCCAC | 192 | ATCTATTCAATCA | 280 |
| 201 | CAAATCTACCCACATCTATTCAATCA | 109 | CAAATCTACCCAC | 219 | ATCTATTCAATCA | 280 |
| 202 | CGAATCTACCCAATCTATTCAATC | 110 | CGAATCTACCCA | 204 | ATCTATTCAATC | 281 |
| 203 | CGAATCTACCCACATCTGTTCAAT | 111 | CGAATCTACCCA | 204 | CATCTGTTCAAT | 282 |
| 204 | CGAATCTACCCATCATCTGTTCAA | 112 | CGAATCTACCCA | 204 | TCATCTGTTCAA | 283 |
| 205 | ACGAATCTACCCATCTGTTCAATC | 113 | ACGAATCTACCC | 205 | ATCTGTTCAATC | 261 |
| 206 | ACGAATCTACCCCATCTGTTCAAT | 114 | ACGAATCTACCC | 205 | CATCTGTTCAAT | 282 |
| 207 | CACGAATCTACCCATCCATGTACT | 115 | CACGAATCTACC | 206 | CATCCATGTACT | 264 |
| 208 | CACGAATCTACCCCATCCATGTAC | 116 | CACGAATCTACC | 206 | CCATCCATGTAC | 262 |
| 209 | CATTTATTCAACGGGATAAGAGTT | 117 | CATTTATTCAAC | 220 | GGGATAAGAGTT | 266 |
| 210 | CATTTATTCAACGGGGATAAGAGT | 118 | CATTTATTCAAC | 220 | GGGGATAAGAGT | 284 |
| 211 | CGAATCTACCCACATCTGTTCAATCA | 2 | CGAATCTACCCAC | 192 | ATCTGTTCAATCA | 247 |
| 212 | CGAATCTACCCACATCTGTTCAATCA | 2 | CGAATCTACCCAC | 192 | ATCTGTTCAATCA | 247 |
| 213 | CGAATCTACCCACATCTGTTCAATCA | 2 | CGAATCTACCCAC | 192 | ATCTGTTCAATCA | 247 |
| 214 | CGAATCTACCCACATCTGTTCAATCA | 2 | CGAATCTACCCAC | 192 | ATCTGTTCAATCA | 247 |
| 215 | CGAATCTACCCAATCTGTTCAATC | 36 | CGAATCTACCCA | 204 | ATCTGTTCAATC | 261 |
| 216 | CGAATCTACCCAATCTGTTCAATC | 36 | CGAATCTACCCA | 204 | ATCTGTTCAATC | 261 |
| 217 | CGAATCTACCCAATCTGTTCAATC | 36 | CGAATCTACCCA | 204 | ATCTGTTCAATC | 261 |
| 218 | CGAATCTACCCAATCTGTTCAATC | 36 | CGAATCTACCCA | 204 | ATCTGTTCAATC | 261 |
| 219 | CGAATCTACCCAATCTGTTCAATC | 36 | CGAATCTACCCA | 204 | ATCTGTTCAATC | 261 |
| 220 | CGAATCTACCCAATCTGTTCAATC | 36 | CGAATCTACCCA | 204 | ATCTGTTCAATC | 261 |
| 221 | CGAATCTACCCAATCTGTTCAATC | 36 | CGAATCTACCCA | 204 | ATCTGTTCAATC | 261 |
| 222 | CGAATCTACCCAATCTGTTCAATC | 36 | CGAATCTACCCA | 204 | ATCTGTTCAATC | 261 |
| 223 | CACGAATCTACCCCCATCCATGTACT | 1 | CACGAATCTACCC | 191 | CCATCCATGTACT | 246 |
| 224 | CACGAATCTACCCCCATCCATGTACT | 1 | CACGAATCTACCC | 191 | CCATCCATGTACT | 246 |
| 225 | CACGAATCTACCCCCATCCATGTACT | 1 | CACGAATCTACCC | 191 | CCATCCATGTACT | 246 |
| 226 | CACGAATCTACCCCCATCCATGTACT | 1 | CACGAATCTACCC | 191 | CCATCCATGTACT | 246 |
| 227 | CCATCCATCATCCGGGATAAGAGTTC | 16 | CCATCCATCATCC | 198 | GGGATAAGAGTTC | 253 |
| 228 | CCATCCATCATCCGGGATAAGAGTTC | 16 | CCATCCATCATCC | 198 | GGGATAAGAGTTC | 253 |
| 229 | CCATCCATCATCCGGGATAAGAGTTC | 16 | CCATCCATCATCC | 198 | GGGATAAGAGTTC | 253 |
| 230 | CCATCCATCATCCGGGATAAGAGTTC | 16 | CCATCCATCATCC | 198 | GGGATAAGAGTTC | 253 |
| 231 | GCATTTATTCAACGGGGATAAGAGTT | 17 | GCATTTATTCAAC | 199 | GGGGATAAGAGTT | 254 |
| 232 | GCATTTATTCAACGGGGATAAGAGTT | 17 | GCATTTATTCAAC | 199 | GGGGATAAGAGTT | 254 |
| 233 | GCATTTATTCAACGGGGATAAGAGTT | 17 | GCATTTATTCAAC | 199 | GGGGATAAGAGTT | 254 |
| 234 | GCATTTATTCAACGGGGATAAGAGTT | 17 | GCATTTATTCAAC | 199 | GGGGATAAGAGTT | 254 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 235 | CGAATCTACCATCCATGTAC | 82 | CGAATCTACC | 212 | ATCCATGTAC | 271 |
| 236 | ATCCATCCATCATTGGGGATAAGAGT | 119 | ATCCATCCATCAT | 221 | TGGGGATAAGAGT | 285 |
| 237 | TCCATCCATCATCGGGGATAAGAGTT | 120 | TCCATCCATCATC | 222 | GGGGATAAGAGTT | 254 |
| 238 | TCCATCCATCATCGGGATAAGAGTTC | 121 | TCCATCCATCATC | 222 | GGGATAAGAGTTC | 253 |
| 239 | TCCATCCATCATCGGATAAGAGTTCT | 122 | TCCATCCATCATC | 222 | GGATAAGAGTTCT | 252 |
| 240 | CCATCCATCATCCGATAAGAGTTCTT | 123 | CCATCCATCATCC | 198 | GATAAGAGTTCTT | 251 |
| 241 | GCATTTATTCAACGGGATAAGAGTTC | 124 | GCATTTATTCAAC | 199 | GGGATAAGAGTTC | 253 |
| 242 | GCATTTATTCAACGGATAAGAGTTCT | 125 | GCATTTATTCAAC | 199 | GGATAAGAGTTCT | 252 |
| 243 | CGAATCTACCCACCCTTTTATCTACT | 126 | CGAATCTACCCAC | 192 | CCTTTTATCTACT | 286 |
| 244 | CGAATCTACCCACCATGTACTCACCC | 127 | CGAATCTACCCAC | 192 | CATGTACTCACCC | 232 |
| 245 | CACGAATCTACCCCCATCCTTTTATC | 128 | CACGAATCTACCC | 191 | CCATCCTTTTATC | 287 |
| 246 | CACGAATCTACCCCTGTTCAATCATT | 129 | CACGAATCTACCC | 191 | CTGTTCAATCATT | 288 |
| 247 | CACGAATCTACCCGTTCAATCATTCA | 130 | CACGAATCTACCC | 191 | GTTCAATCATTCA | 289 |
| 248 | CGAATCTACCCACTCCTTTTATCTAC | 131 | CGAATCTACCCAC | 192 | TCCTTTTATCTAC | 290 |
| 249 | CGAATCTACCCACCTGTTCAATCATT | 132 | CGAATCTACCCAC | 192 | CTGTTCAATCATT | 288 |
| 250 | CGAATCTACCCACCTTTTATCTACTC | 133 | CGAATCTACCCAC | 192 | CTTTTATCTACTC | 291 |
| 251 | CGAATCTACCCACGTTCAATCATTCA | 134 | CGAATCTACCCAC | 192 | GTTCAATCATTCA | 289 |
| 252 | ACGAATCTACCCAGTACTCACCCATC | 135 | ACGAATCTACCCA | 196 | GTACTCACCCATC | 226 |
| 253 | CGAATCTACCCACTGTTCAATCATTC | 136 | CGAATCTACCCAC | 192 | TGTTCAATCATTC | 194 |
| 254 | CACGAATCTACCCCATCTGTTCAATC | 137 | CACGAATCTACCC | 191 | CATCTGTTCAATC | 276 |
| 255 | CACGAATCTACCCCCTTTTATCTACT | 138 | CACGAATCTACCC | 191 | CCTTTTATCTACT | 286 |
| 256 | CACGAATCTACCCCCATGTACTCACC | 139 | CACGAATCTACCC | 191 | CCATGTACTCACC | 227 |
| 257 | CGAATCTACCCACATTCACCAGCATT | 140 | CGAATCTACCCAC | 192 | ATTCACCAGCATT | 292 |
| 258 | CGAATCTACCCACCATCTGTTCAATC | 141 | CGAATCTACCCAC | 192 | CATCTGTTCAATC | 276 |
| 259 | ACGAATCTACCCACCATCCTTTTATC | 142 | ACGAATCTACCCA | 196 | CCATCCTTTTATC | 287 |
| 260 | CGAATCTACCCACGTACTCACCCATC | 143 | CGAATCTACCCAC | 192 | GTACTCACCCATC | 226 |
| 261 | CACGAATCTACCCGTACTCACCCATC | 144 | CACGAATCTACCC | 191 | GTACTCACCCATC | 226 |
| 262 | ACGAATCTACCCAATTCACCAGCATT | 145 | ACGAATCTACCCA | 196 | ATTCACCAGCATT | 292 |
| 263 | CGAATCTACCCACGAAACCCAGGCAG | 146 | CGAATCTACCCAC | 192 | GAAACCCAGGCAG | 293 |
| 264 | CCACGAATCTACCGGAAACCCAGGCA | 147 | CCACGAATCTACC | 193 | GGAAACCCAGGCA | 294 |
| 265 | CAATCATATATCCGGAAACCCAGGCA | 148 | CAATCATATATCC | 223 | GGAAACCCAGGCA | 294 |
| 266 | CAATAGTTCAATCGGAAACCCAGGCA | 149 | CAATAGTTCAATC | 224 | GGAAACCCAGGCA | 294 |
| 267 | TCTAGCCACGAATTTCCAGGAAACCC | 150 | TCTAGCCACGAAT | 225 | TTCCAGGAAACCC | 295 |
| 268 | GTACTCACCCATCGATAAGAGTTCTT | 151 | GTACTCACCCATC | 226 | GATAAGAGTTCTT | 251 |
| 269 | CCATGTACTCACCGGATAAGAGTTCT | 152 | CCATGTACTCACC | 227 | GGATAAGAGTTCT | 252 |
| 270 | TGTCCATCCATCCGGATAAGAGTTCT | 153 | TGTCCATCCATCC | 228 | GGATAAGAGTTCT | 252 |
| 271 | TTCATTCACCAGCGGGATAAGAGTTC | 154 | TTCATTCACCAGC | 229 | GGGATAAGAGTTC | 253 |
| 272 | CTACTCATCACTCGGGATAAGAGTTC | 155 | CTACTCATCACTC | 230 | GGGATAAGAGTTC | 253 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 273 | TCTCCATCCATCCGGGATAAGAGTTC | 156 | TCTCCATCCATCC | 231 | GGGATAAGAGTTC | 253 |
| 274 | GTACTCACCCATCGGGATAAGAGTTC | 157 | GTACTCACCCATC | 226 | GGGATAAGAGTTC | 253 |
| 275 | CATGTACTCACCCGGGATAAGAGTTC | 158 | CATGTACTCACCC | 232 | GGGATAAGAGTTC | 253 |
| 276 | CATCCATCTATCCGGGATAAGAGTTC | 159 | CATCCATCTATCC | 233 | GGGATAAGAGTTC | 253 |
| 277 | CCATCCATCTGTCGGGATAAGAGTTC | 160 | CCATCCATCTGTC | 234 | GGGATAAGAGTTC | 253 |
| 278 | CCAGCATTTATTCGGGGATAAGAGTT | 161 | CCAGCATTTATTC | 235 | GGGGATAAGAGTT | 254 |
| 279 | TTCATTCACCAGCGGGGATAAGAGTT | 162 | TTCATTCACCAGC | 229 | GGGGATAAGAGTT | 254 |
| 280 | TGTTCAATCATTCGGGGATAAGAGTT | 163 | TGTTCAATCATTC | 194 | GGGGATAAGAGTT | 254 |
| 281 | TTATCTACTCATCGGGGATAAGAGTT | 164 | TTATCTACTCATC | 236 | GGGGATAAGAGTT | 254 |
| 282 | CACCCATCTCTCCGGGGATAAGAGTT | 165 | CACCCATCTCTCC | 237 | GGGGATAAGAGTT | 254 |
| 283 | GTACTCACCCATCGGGGATAAGAGTT | 166 | GTACTCACCCATC | 226 | GGGGATAAGAGTT | 254 |
| 284 | CATGTACTCACCCGGGGATAAGAGTT | 167 | CATGTACTCACCC | 232 | GGGGATAAGAGTT | 254 |
| 285 | CCATCTATCCATCGGGGATAAGAGTT | 168 | CCATCTATCCATC | 238 | GGGGATAAGAGTT | 254 |
| 286 | CATCCATCTAGCCGGGGATAAGAGTT | 169 | CATCCATCTAGCC | 239 | GGGGATAAGAGTT | 254 |
| 287 | CTGTCCATCCATCGGGGATAAGAGTT | 170 | CTGTCCATCCATC | 240 | GGGGATAAGAGTT | 254 |
| 288 | CAATCATATATCCGGGGATAAGAGTT | 171 | CAATCATATATCC | 223 | GGGGATAAGAGTT | 254 |
| 289 | CCATCTAGCCACGTTCCTGGGGATAA | 172 | CCATCTAGCCACG | 241 | TTCCTGGGGATAA | 296 |
| 290 | CATGTACTCACCCGTTCCTGGGGATA | 173 | CATGTACTCACCC | 232 | GTTCCTGGGGATA | 257 |
| 291 | CTAGCCACGAATCACTAGTTCCTGGG | 174 | CTAGCCACGAATC | 197 | ACTAGTTCCTGGG | 297 |
| 292 | CCACGAATCTACCGCATTTATTCAAC | 175 | CCACGAATCTACC | 193 | GCATTTATTCAAC | 199 |
| 293 | CTAGCCACGAATCGTACTCACCCATC | 176 | CTAGCCACGAATC | 197 | GTACTCACCCATC | 226 |
| 294 | GAATCTACCCACTTCACCAGCATT | 177 | GAATCTACCCAC | 203 | TTCACCAGCATT | 298 |
| 295 | CGAATCTACCCATTCACCAGCATT | 178 | CGAATCTACCCA | 204 | TTCACCAGCATT | 298 |
| 296 | GAATCTACCCACATTCACCAGCAT | 179 | GAATCTACCCAC | 203 | ATTCACCAGCAT | 299 |
| 297 | CGAATCTACCCAATTCACCAGCAT | 180 | CGAATCTACCCA | 204 | ATTCACCAGCAT | 299 |
| 298 | GAATCTACCCACTTCACCAGCATT | 177 | GAATCTACCCAC | 203 | TTCACCAGCATT | 298 |
| 299 | CGAATCTACCCATTCACCAGCATT | 178 | CGAATCTACCCA | 204 | TTCACCAGCATT | 298 |
| 300 | GAATCTACCCACATTCACCAGCAT | 179 | GAATCTACCCAC | 203 | ATTCACCAGCAT | 299 |
| 301 | CGAATCTACCCAATTCACCAGCAT | 180 | CGAATCTACCCA | 204 | ATTCACCAGCAT | 299 |
| 302 | CGAATCTACCCACATTCACCAGCATT | 140 | CGAATCTACCCAC | 192 | ATTCACCAGCATT | 292 |
| 303 | CGAATCTACCCACATTCACCAGCATT | 140 | CGAATCTACCCAC | 192 | ATTCACCAGCATT | 292 |
| 304 | CGAATCTACCCACATTCACCAGCATT | 140 | CGAATCTACCCAC | 192 | ATTCACCAGCATT | 292 |
| 305 | GAATCTACCCACATTCACCAGCATT | 181 | GAATCTACCCAC | 203 | ATTCACCAGCATT | 292 |
| 306 | CGAATCTACCCACATTCACCAGCAT | 182 | CGAATCTACCCAC | 192 | ATTCACCAGCAT | 299 |
| 307 | CGAATCTACCCATTCACCAGCATT | 178 | CGAATCTACCCA | 204 | TTCACCAGCATT | 298 |
| 308 | CGAATCTACCCATTCACCAGCATT | 178 | CGAATCTACCCA | 204 | TTCACCAGCATT | 298 |
| 309 | CATATATCCATCTAGCCACG | 183 | CATATATCCA | 242 | TCTAGCCACG | 300 |

TABLE 3-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 310 | ACGAATCTACCCATCCATGT | 184 | ACGAATCTAC | 243 | CCATCCATGT | 301 |
| 311 | TGTCCATCCACGAATCTACC | 185 | TGTCCATCCA | 244 | CGAATCTACC | 212 |
| 312 | CGAATCTACCAACTCATCCA | 186 | CGAATCTACC | 212 | AACTCATCCA | 302 |
| 313 | ACGAATCTACCATCCATGTA | 187 | ACGAATCTAC | 243 | CATCCATGTA | 303 |
| 314 | CGAATCTACCCATCTCTCCA | 188 | CGAATCTACC | 212 | CATCTCTCCA | 304 |
| 315 | CACGAATCTACCCATCTCTC | 189 | CACGAATCTA | 245 | CCCATCTCTC | 305 |
| 316 | ACGAATCTACCCATCTCTCC | 190 | ACGAATCTAC | 243 | CCATCTCTCC | 306 |
| 317 | CGAATCTACCATCCATGTAC | 82 | CGAATCTACC | 212 | ATCCATGTAC | 271 |
| 318 | CGAATCTACCATCCATGTAC | 82 | CGAATCTACC | 212 | ATCCATGTAC | 271 |
| 319 | CGAATCTACCATCCATGTAC | 82 | CGAATCTACC | 212 | ATCCATGTAC | 271 |
| 320 | CGAATCTACCATCCATGTAC | 82 | CGAATCTACC | 212 | ATCCATGTAC | 271 |
| 321 | CGAATCTACCATCCATGTAC | 82 | CGAATCTACC | 212 | ATCCATGTAC | 271 |
| 322 | CGAATCTACCATCCATGTAC | 82 | CGAATCTACC | 212 | ATCCATGTAC | 271 |
| 323 | CGAATCTACCATCCATGTAC | 82 | CGAATCTACC | 212 | ATCCATGTAC | 271 |
| 324 | CGAATCTACCATCCATGTAC | 82 | CGAATCTACC | 212 | ATCCATGTAC | 271 |
| 325 | CGAATCTACCATCCATGTAC | 82 | CGAATCTACC | 212 | ATCCATGTAC | 271 |
| 326 | CGAATCTACCATCCATGTAC | 82 | CGAATCTACC | 212 | ATCCATGTAC | 271 |
| 327 | CGAATCTACCCACATCTGTTCAATCA | 2 | CGAATCTACCCAC | 192 | ATCTGTTCAATCA | 247 |
| 328 | CGAATCTACCCACATCTGTTCAATCA | 2 | CGAATCTACCCAC | 192 | ATCTGTTCAATCA | 247 |
| 329 | CACGAATCTACCCCCATCCATGTACT | 1 | CACGAATCTACCC | 191 | CCATCCATGTACT | 246 |
| 330 | CCATCCATCATCCGGGATAAGAGTTC | 16 | CCATCCATCATCC | 198 | GGGATAAGAGTTC | 253 |
| 331 | GCATTTATTCAACGGGGATAAGAGTT | 17 | GCATTTATTCAAC | 199 | GGGGATAAGAGTT | 254 |

†When C is provided in a nucleobase sequence disclosed herein, without modification, such as in Table 3, it encompasses cytidine or 5'-methyl cytidine †Each thymine base (T) in any one of the oligonucleotide sequences provided in Table 3 may independently and optionally be replaced with a uracil base (U).

TABLE 9

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 350 | GCATTTATTCAACGGGGATAAGAGTT | 17 | GCATTTATTCAAC | 199 | GGGGATAAGAGTT | 254 |
| 351 | GCATTTATTCAACGGGGATAAGAGTT | 17 | GCATTTATTCAAC | 199 | GGGGATAAGAGTT | 254 |
| 352 | GCATTTATTCAACGGGATAAGAGTTC | 124 | GCATTTATTCAAC | 199 | GGGATAAGAGTTC | 253 |
| 353 | GCATTTATTCAACGGGATAAGAGTTC | 124 | GCATTTATTCAAC | 199 | GGGATAAGAGTTC | 253 |
| 354 | GCATTTATTCAACGGGATAAGAGTTC | 124 | GCATTTATTCAAC | 199 | GGGATAAGAGTTC | 253 |
| 355 | GCATTTATTCAACGGGATAAGAGTTC | 124 | GCATTTATTCAAC | 199 | GGGATAAGAGTTC | 253 |
| 356 | GCATTTATTCAACGGGATAAGAGTTC | 124 | GCATTTATTCAAC | 199 | GGGATAAGAGTTC | 253 |
| 357 | GCATTTATTCAACGGATAAGAGTTCT | 125 | GCATTTATTCAAC | 199 | GGATAAGAGTTCT | 252 |
| 358 | CATTTATTCAACGGATAAGAGTTC | 338 | CATTTATTCAAC | 220 | GGATAAGAGTTC | 267 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 359 | CATTTATTCAACGGATAAGAGTTC | 338 | CATTTATTCAAC | 220 | GGATAAGAGTTC | 267 |
| 360 | CATTTATTCAACGGGATAAGAGTT | 117 | CATTTATTCAAC | 220 | GGGATAAGAGTT | 266 |
| 361 | CATTTATTCAACGGGGATAAGAGTT | 339 | CATTTATTCAAC | 220 | GGGGATAAGAGTT | 254 |
| 362 | GCATTTATTCAAGGGGATAAGAGTT | 340 | GCATTTATTCAA | 495 | GGGGATAAGAGTT | 254 |
| 363 | GCATTTATTCAACGGGATAAGAGTT | 341 | GCATTTATTCAAC | 199 | GGGATAAGAGTT | 266 |
| 364 | GCATTTATTCAACGGGGATAAGAGT | 342 | GCATTTATTCAAC | 199 | GGGGATAAGAGT | 284 |
| 365 | TGTTCAATCATTCGGGATAAGAGTTC | 9 | TGTTCAATCATTC | 194 | GGGATAAGAGTTC | 253 |
| 366 | TGTTCAATCATTCGGGATAAGAGTTC | 9 | TGTTCAATCATTC | 194 | GGGATAAGAGTTC | 253 |
| 367 | TGTTCAATCATTCGGGATAAGAGTTC | 9 | TGTTCAATCATTC | 194 | GGGATAAGAGTTC | 253 |
| 368 | TGTTCAATCATTCGGGATAAGAGTTC | 9 | TGTTCAATCATTC | 194 | GGGATAAGAGTTC | 253 |
| 369 | TGTTCAATCATTCGGGATAAGAGTTC | 9 | TGTTCAATCATTC | 194 | GGGATAAGAGTTC | 253 |
| 370 | TGTTCAATCATTGGGATAAGAGTTC | 343 | TGTTCAATCATT | 496 | GGGATAAGAGTTC | 253 |
| 371 | TGTTCAATCATTCGGGATAAGAGTT | 344 | TGTTCAATCATTC | 194 | GGGATAAGAGTT | 266 |
| 372 | TGTTCAATCATTCGGGATAAGAGTTC | 9 | TGTTCAATCATTC | 194 | GGGATAAGAGTTC | 253 |
| 373 | TGTTCAATCATTCGGGATAAGAGTTC | 9 | TGTTCAATCATTC | 194 | GGGATAAGAGTTC | 253 |
| 374 | TGTTCAATCATTCGGGATAAGAGTTC | 9 | TGTTCAATCATTC | 194 | GGGATAAGAGTTC | 253 |
| 375 | TGTTCAATCATTCGGGATAAGAGTTC | 9 | TGTTCAATCATTC | 194 | GGGATAAGAGTTC | 253 |
| 376 | TGTTCAATCATTCGGGATAAGAGTTC | 9 | TGTTCAATCATTC | 194 | GGGATAAGAGTTC | 253 |
| 377 | TGTTCAATCATTCGGGATAAGAGTTC | 9 | TGTTCAATCATTC | 194 | GGGATAAGAGTTC | 253 |
| 378 | TGTTCAATCATTCGGGATAAGAGTTC | 9 | TGTTCAATCATTC | 194 | GGGATAAGAGTTC | 253 |
| 379 | TGTTCAATCATTCGGGATAAGAGTTC | 9 | TGTTCAATCATTC | 194 | GGGATAAGAGTTC | 253 |
| 380 | TGTTCAATCATTCGGGATAAGAGTTC | 9 | TGTTCAATCATTC | 194 | GGGATAAGAGTTC | 253 |
| 381 | TGTTCAATCATTCGGGATAAGAGTTC | 9 | TGTTCAATCATTC | 194 | GGGATAAGAGTTC | 253 |
| 382 | TGTTCAATCATTCGGGATAAGAGTTC | 9 | TGTTCAATCATTC | 194 | GGGATAAGAGTTC | 253 |
| 383 | TGTTCAATCATTCGGGATAAGAGTTC | 9 | TGTTCAATCATTC | 194 | GGGATAAGAGTTC | 253 |
| 384 | TGTTCAATCATTCGGGATAAGAGTTC | 9 | TGTTCAATCATTC | 194 | GGGATAAGAGTTC | 253 |
| 385 | TGTTCAATCATTCGGGATAAGAGTTC | 9 | TGTTCAATCATTC | 194 | GGGATAAGAGTTC | 253 |
| 386 | TGTTCAATCATTCGGGATAAGAGTTC | 9 | TGTTCAATCATTC | 194 | GGGATAAGAGTTC | 253 |
| 387 | TGTTCAATCATTCGGGATAAGAGTTC | 9 | TGTTCAATCATTC | 194 | GGGATAAGAGTTC | 253 |
| 388 | TGTTCAATCATTCGGGATAAGAGTTC | 9 | TGTTCAATCATTC | 194 | GGGATAAGAGTTC | 253 |
| 389 | TGTTCAATCATTCGGGATAAGAGTTC | 9 | TGTTCAATCATTC | 194 | GGGATAAGAGTTC | 253 |
| 390 | TGTTCAATCATTCGGGATAAGAGTTC | 9 | TGTTCAATCATTC | 194 | GGGATAAGAGTTC | 253 |
| 391 | TGTTCAATCATTCGGGATAAGAGTTC | 9 | TGTTCAATCATTC | 194 | GGGATAAGAGTTC | 253 |
| 392 | TGTTCAATCATTCGGGATAAGAGTTC | 9 | TGTTCAATCATTC | 194 | GGGATAAGAGTTC | 253 |
| 393 | TGTTCAATCATTCGGGATAAGAGTTC | 9 | TGTTCAATCATTC | 194 | GGGATAAGAGTTC | 253 |
| 394 | TGTTCAATCATTCGGGATAAGAGTTC | 9 | TGTTCAATCATTC | 194 | GGGATAAGAGTTC | 253 |
| 395 | TGTTCAATCATTCGGGATAAGAGTTC | 9 | TGTTCAATCATTC | 194 | GGGATAAGAGTTC | 253 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 396 | TGTTCAATCATTCGGGATAAGAGTTC | 345 | TGTTCAATCATTC | 194 | GGGATAAGAGTTC | 253 |
| 397 | TGTTCAATCATTCGGGATAAGAGTTC | 9 | TGTTCAATCATTC | 194 | GGGATAAGAGTTC | 253 |
| 398 | TGTTCAATCATTCGGGATAAGAGTTC | 9 | TGTTCAATCATTC | 194 | GGGATAAGAGTTC | 253 |
| 399 | TGTTCAATCATTCGGGATAAGAGTTC | 9 | TGTTCAATCATTC | 194 | GGGATAAGAGTTC | 253 |
| 400 | TGTTCAATCATTCGGGATAAGAGTTC | 9 | TGTTCAATCATTC | 194 | GGGATAAGAGTTC | 253 |
| 401 | TGTTCAATCATTCGGGATAAGAGTTC | 9 | TGTTCAATCATTC | 194 | GGGATAAGAGTTC | 253 |
| 402 | TGTTCAATCATTCGGGATAAGAGTTC | 9 | TGTTCAATCATTC | 194 | GGGATAAGAGTTC | 253 |
| 403 | TGTTCAATCATTCGGGATAAGAGTTC | 9 | TGTTCAATCATTC | 194 | GGGATAAGAGTTC | 253 |
| 404 | TGTTCAATCATTCGGGATAAGAGTTC | 9 | TGTTCAATCATTC | 194 | GGGATAAGAGTTC | 253 |
| 405 | TGTTCAATCATTCGGGATAAGAGTTC | 9 | TGTTCAATCATTC | 194 | GGGATAAGAGTTC | 253 |
| 406 | TGTTCAATCATTCGGGATAAGAGTTC | 9 | TGTTCAATCATTC | 194 | GGGATAAGAGTTC | 253 |
| 407 | TGTTCAATCATTC[n3]GGGATAAGAGTTC | 194/ 253 | TGTTCAATCATTC | 194 | GGGATAAGAGTTC | 253 |
| 408 | TGTTCAATCATTC[n6]GGGATAAGAGTTC | 194/ 253 | TGTTCAATCATTC | 194 | GGGATAAGAGTTC | 253 |
| 409 | TCTGTTCAATCATTGGGGATAAGAGT | 347 | TCTGTTCAATCAT | 274 | TGGGGATAAGAGT | 285 |
| 410 | TCTGTTCAATCATGGGGATAAGAGTT | 348 | TCTGTTCAATCAT | 274 | GGGGATAAGAGTT | 254 |
| 411 | TCTGTTCAATCATGGGATAAGAGTTC | 349 | TCTGTTCAATCAT | 274 | GGGATAAGAGTTC | 253 |
| 412 | CTGTTCAATCATTTGGGGATAAGAGT | 350 | CTGTTCAATCATT | 288 | TGGGGATAAGAGT | 285 |
| 413 | CTGTTCAATCATTGGGGATAAGAGTT | 351 | CTGTTCAATCATT | 288 | GGGGATAAGAGTT | 254 |
| 414 | CTGTTCAATCATTGGGATAAGAGTTC | 352 | CTGTTCAATCATT | 288 | GGGATAAGAGTTC | 253 |
| 415 | TGTTCAATCATTCTGGGGATAAGAGT | 353 | TGTTCAATCATTC | 194 | TGGGGATAAGAGT | 285 |
| 416 | TGTTCAATCATTCGGGGATAAGAGTT | 163 | TGTTCAATCATTC | 194 | GGGGATAAGAGTT | 254 |
| 417 | TGTTCAATCATTCGGATAAGAGTTCT | 354 | TGTTCAATCATTC | 194 | GGATAAGAGTTCT | 252 |
| 418 | TGTTCAATCATTCGGGATAAGAGTTC | 9 | TGTTCAATCATTC | 194 | GGGATAAGAGTTC | 253 |
| 419 | TCCATCCATCCTTGAGTTCTTTCCAG | 355 | TCCATCCATCCTT | 497 | GAGTTCTTTCCAG | 249 |
| 420 | TCCATCCATCCTT[n6]GAGTTCTTTCCAG | 497/ 249 | TCCATCCATCCTT | 497 | GAGTTCTTTCCAG | 249 |
| 421 | CTCTCCATCCATCTTCTTTCCAGGAA | 357 | CTCTCCATCCATC | 498 | TTCTTTCCAGGAA | 516 |
| 422 | TCCATCCATCCTTGAGTTCTTTCCAG | 355 | TCCATCCATCCTT | 497 | GAGTTCTTTCCAG | 249 |
| 423 | CATCCATCTATCCGGGATAAGAGTTC | 159 | CATCCATCTATCC | 233 | GGGATAAGAGTTC | 253 |
| 424 | CATCCATCTATCCGGGATAAGAGTTC | 159 | CATCCATCTATCC | 233 | GGGATAAGAGTTC | 253 |
| 425 | CATCCATCTATCCGGGATAAGAGTTC | 159 | CATCCATCTATCC | 233 | GGGATAAGAGTTC | 253 |
| 426 | CATCCATCTATCCGGGATAAGAGTTC | 159 | CATCCATCTATCC | 233 | GGGATAAGAGTTC | 253 |
| 427 | CATCCATCTATCCGGGATAAGAGTTC | 159 | CATCCATCTATCC | 233 | GGGATAAGAGTTC | 253 |
| 428 | ATCCATCTATCCGGATAAGAGTTC | 358 | ATCCATCTATCC | 499 | GGATAAGAGTTC | 267 |
| 429 | ATCCATCTATCCGGGATAAGAGTT | 359 | ATCCATCTATCC | 499 | GGGATAAGAGTT | 266 |
| 430 | ATCCATCTATCCGGATAAGAGTTC | 358 | ATCCATCTATCC | 499 | GGATAAGAGTTC | 267 |
| 431 | ATCCATCTATCCGGGATAAGAGTT | 359 | ATCCATCTATCC | 499 | GGGATAAGAGTT | 266 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 432 | CAACTCATCCATCAGAGTTCTTTCCA | 360 | CAACTCATCCATC | 500 | AGAGTTCTTTCCA | 517 |
| 433 | GCCACGAATCTACGGATAAGAGTTCT | 361 | GCCACGAATCTAC | 201 | GGATAAGAGTTCT | 252 |
| 434 | CCACGAATCTACCGGGATAAGAGTTC | 14 | CCACGAATCTACC | 193 | GGGATAAGAGTTC | 253 |
| 435 | CCACGAATCTACCGGGATAAGAGTTC | 14 | CCACGAATCTACC | 193 | GGGATAAGAGTTC | 253 |
| 436 | CCACGAATCTACCGGGATAAGAGTTC | 14 | CCACGAATCTACC | 193 | GGGATAAGAGTTC | 253 |
| 437 | CCACGAATCTACCGGGATAAGAGTTC | 14 | CCACGAATCTACC | 193 | GGGATAAGAGTTC | 253 |
| 438 | CCACGAATCTACCGGGATAAGAGTTC | 14 | CCACGAATCTACC | 193 | GGGATAAGAGTTC | 253 |
| 439 | CCACGAATCTACCGGATAAGAGTTCT | 8 | CCACGAATCTACC | 193 | GGATAAGAGTTCT | 252 |
| 440 | CCACGAATCTACCGGATAAGAGTTCT | 8 | CCACGAATCTACC | 193 | GGATAAGAGTTCT | 252 |
| 441 | CCACGAATCTACCGGATAAGAGTTCT | 8 | CCACGAATCTACC | 193 | GGATAAGAGTTCT | 252 |
| 442 | CCACGAATCTACCGGATAAGAGTTCT | 8 | CCACGAATCTACC | 193 | GGATAAGAGTTCT | 252 |
| 443 | CCACGAATCTACCGGATAAGAGTTCT | 8 | CCACGAATCTACC | 193 | GGATAAGAGTTCT | 252 |
| 444 | CACGAATCTACCGATAAGAGTTCT | 362 | CACGAATCTACC | 206 | GATAAGAGTTCT | 518 |
| 445 | CCACGAATCTACGATAAGAGTTCT | 363 | CCACGAATCTAC | 501 | GATAAGAGTTCT | 518 |
| 446 | CACGAATCTACCGGGGATAAGAGT | 364 | CCACGAATCTAC | 501 | GGGGATAAGAGT | 284 |
| 447 | CCACGAATCTACGGGGATAAGAGT | 365 | GCCACGAATCTA | 502 | GGGGATAAGAGT | 284 |
| 448 | CACGAATCTACCGGATAAGAGTTC | 366 | CACGAATCTACC | 206 | GGATAAGAGTTC | 267 |
| 449 | CACGAATCTACCGGGATAAGAGTT | 367 | CACGAATCTACC | 206 | GGGATAAGAGTT | 266 |
| 450 | CCACGAATCTACGGATAAGAGTTC | 368 | CCACGAATCTAC | 501 | GGATAAGAGTTC | 267 |
| 451 | CCACGAATCTACGGGATAAGAGTT | 369 | CCACGAATCTAC | 501 | GGGATAAGAGTT | 266 |
| 452 | CACGAATCTACCGATAAGAGTTCT | 362 | CACGAATCTACC | 206 | GATAAGAGTTCT | 518 |
| 453 | CCACGAATCTACGGGGATAAGAGT | 365 | CCACGAATCTAC | 501 | GGGGATAAGAGT | 284 |
| 454 | CCACGAATCTACCGGGGATAAGAGTT | 22 | CCACGAATCTACC | 193 | GGGGATAAGAGTT | 254 |
| 455 | CCACGAATCTACCGGGGATAAGAGTT | 22 | CCACGAATCTACC | 193 | GGGGATAAGAGTT | 254 |
| 456 | CCACGAATCTACCGGGGATAAGAGTT | 22 | CCACGAATCTACC | 193 | GGGGATAAGAGTT | 254 |
| 457 | CCACGAATCTACCGGGGATAAGAGTT | 22 | CCACGAATCTACC | 193 | GGGGATAAGAGTT | 254 |
| 458 | CCACGAATCTACCGGGGATAAGAGTT | 22 | CCACGAATCTACC | 193 | GGGGATAAGAGTT | 254 |
| 459 | ACGAATCTACCCAGGGGATAAGAGTT | 370 | ACGAATCTACCCA | 196 | GGGGATAAGAGTT | 254 |
| 460 | CTAGCCACGAATCTAAGAGTTCTTTC | 371 | CTAGCCACGAATC | 197 | TAAGAGTTCTTTC | 250 |
| 461 | CCACGAATCTACCATAAGAGTTCTTT | 372 | CCACGAATCTACC | 193 | ATAAGAGTTCTTT | 519 |
| 462 | CCATCCATCATCCGGGATAAGAGTCC | 373 | CCATCCATCATCC | 198 | GGGATAAGAGTTC | 253 |
| 463 | TCCATCCATCATCGGGGATAAGAGTT | 120 | TCCATCCATCATC | 222 | GGGGATAAGAGTT | 254 |
| 464 | TCCATCCATCATCGGGGATAAGAGTT | 120 | TCCATCCATCATC | 222 | GGGGATAAGAGTT | 254 |
| 465 | TCCATCCATCATCGGGGATAAGAGTT | 120 | TCCATCCATCATC | 222 | GGGGATAAGAGTT | 254 |
| 466 | TCCATCCATCATCGGGGATAAGAGTT | 120 | TCCATCCATCATC | 222 | GGGGATAAGAGTT | 254 |
| 467 | TCCATCCATCATCGGGGATAAGAGTT | 120 | TCCATCCATCATC | 222 | GGGGATAAGAGTT | 254 |
| 468 | TCCATCCATCATCGGGATAAGAGTTC | 121 | TCCATCCATCATC | 222 | GGGATAAGAGTTC | 253 |
| 469 | TCCATCCATCATCGGGATAAGAGTTC | 121 | TCCATCCATCATC | 222 | GGGATAAGAGTTC | 253 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 470 | TCCATCCATCATCGGGATAAGAGTTC | 121 | TCCATCCATCATC | 222 | GGGATAAGAGTTC | 253 |
| 471 | TCCATCCATCATCGGGATAAGAGTTC | 121 | TCCATCCATCATC | 222 | GGGATAAGAGTTC | 253 |
| 472 | TCCATCCATCATCGGGATAAGAGTTC | 121 | TCCATCCATCATC | 222 | GGGATAAGAGTTC | 253 |
| 473 | TCCATCCATCATCGGATAAGAGTTCT | 122 | TCCATCCATCATC | 222 | GGATAAGAGTTCT | 252 |
| 474 | CCATCCATCATCCGATAAGAGTTCTT | 123 | CCATCCATCATCC | 198 | GATAAGAGTTCTT | 251 |
| 475 | CCATCCATCATCCGATAAGAGTTCTT | 123 | CCATCCATCATCC | 198 | GATAAGAGTTCTT | 251 |
| 476 | CCATCCATCATCCGATAAGAGTTCTT | 123 | CCATCCATCATCC | 198 | GATAAGAGTTCTT | 251 |
| 477 | CCATCCATCATCCGATAAGAGTTCTT | 123 | CCATCCATCATCC | 198 | GATAAGAGTTCTT | 251 |
| 478 | CCATCCATCATCGGGGATAAGAGT | 374 | CCATCCATCATC | 208 | GGGGATAAGAGT | 284 |
| 479 | CCATCCATCATCGGGGATAAGAGT | 374 | CCATCCATCATC | 208 | GGGGATAAGAGT | 284 |
| 480 | CCATCCATCATCGGATAAGAGTTC | 48 | CCATCCATCATC | 208 | GGATAAGAGTTC | 267 |
| 481 | TCATCCATCTAGCGGGATAAGAGTTC | 375 | TCATCCATCTAGC | 503 | GGGATAAGAGTTC | 253 |
| 482 | CATCCATCTAGCCGGGATAAGAGTTC | 376 | CATCCATCTAGCC | 239 | GGGATAAGAGTTC | 253 |
| 483 | TCCATCTAGCCACGGGGATAAGAGTT | 377 | TCCATCTAGCCAC | 504 | GGGGATAAGAGTT | 254 |
| 484 | ATCCATCTAGCCGGGATAAGAGTT | 378 | ATCCATCTAGCC | 505 | GGGATAAGAGTT | 266 |
| 485 | ATCCATCTAGCCGGGGATAAGAGT | 379 | ATCCATCTAGCC | 505 | GGGGATAAGAGT | 284 |
| 486 | CCATCCATCATCCGGGGATAAGAGTT | 380 | CCATCCATCATCC | 198 | GGGGATAAGAGTT | 254 |
| 487 | ATATATCCATCCACTAGTTCCTGGGG | 381 | ATATATCCATCCA | 506 | CTAGTTCCTGGGG | 259 |
| 488 | ATATATCCATCCA[n6]CTAGTTCCTGGGG | 506/ 259 | ATATATCCATCCA | 506 | CTAGTTCCTGGGG | 259 |
| 489 | ATATATCCATCCACTAGTTCCTGGGG | 381 | ATATATCCATCCA | 506 | CTAGTTCCTGGGG | 259 |
| 490 | TAGTTCAATCATAAGAGTTCTTTCCA | 383 | TAGTTCAATCATA | 507 | AGAGTTCTTTCCA | 517 |
| 491 | TCATCTGTTCAACAAACTAG | 384 | TCATCTGTTC | 508 | AACAAACTAG | 520 |
| 492 | ATCTGTTCAATCAGCATTTATTCAAC | 385 | ATCTGTTCAATCA | 247 | GCATTTATTCAAC | 199 |
| 493 | ATCTACCCACCAGCATTTAT | 386 | ATCTACCCAC | 509 | CAGCATTTAT | 521 |
| 494 | CCACGAATCTACCGTTCAATCATTCA | 387 | CCACGAATCTACC | 193 | GTTCAATCATTCA | 289 |
| 495 | CACGAATCTACCCATTCACCAGCATT | 388 | CACGAATCTACCC | 191 | ATTCACCAGCATT | 292 |
| 496 | ACGAATCTACCCAGTTCAATCATTCA | 389 | ACGAATCTACCCA | 196 | GTTCAATCATTCA | 289 |
| 497 | CCACGAATCTACCGTTCAATCATTCA | 387 | CCACGAATCTACC | 193 | GTTCAATCATTCA | 289 |
| 498 | CCACGAATCTACCGTTCAATCATTCA | 387 | CCACGAATCTACC | 193 | GTTCAATCATTCA | 289 |
| 499 | CACGAATCTACCCATTCACCAGCATT | 388 | CACGAATCTACCC | 191 | ATTCACCAGCATT | 292 |
| 500 | CACGAATCTACCCATTCACCAGCATT | 388 | CACGAATCTACCC | 191 | ATTCACCAGCATT | 292 |
| 501 | CCATCCATGTACTCAATCAT | 390 | CCATCCATGTACT | 246 | CAATCAT | |
| 502 | GAATCTACCCATCTGTTCAATC | 106 | GAATCTACCCA | 218 | TCTGTTCAATC | 279 |
| 503 | CGAATCTACCCAATCTGTTCAATC | 36 | CGAATCTACCCA | 204 | ATCTGTTCAATC | 261 |
| 504 | CGAATCTACCCACATCTGTTCAATCA | 2 | CGAATCTACCCAC | 192 | ATCTGTTCAATCA | 247 |
| 505 | CGAATCTACCCACATCTGTTCAATCA | 2 | CGAATCTACCCAC | 192 | ATCTGTTCAATCA | 247 |
| 506 | ACGAATCTACCCACATCTGTTCAATC | 93 | ACGAATCTACCCA | 196 | CATCTGTTCAATC | 276 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 507 | CGAATCTACCCACATCTGTTCAAT | 111 | CGAATCTACCCAC | 192 | ATCTGTTCAAT | 273 |
| 508 | ACGAATCTACCCATCTGTTCAATC | 113 | ACGAATCTACCC | 205 | ATCTGTTCAATC | 261 |
| 509 | ACGAATCTACCCACATCTGTTCAATC | 93 | ACGAATCTACCCA | 196 | CATCTGTTCAATC | 276 |
| 510 | ACGAATCTACCCACATCTGTTCAATC | 93 | ACGAATCTACCCA | 196 | CATCTGTTCAATC | 276 |
| 511 | ACGAATCTACCCACATCTGTTCAATC | 93 | ACGAATCTACCCA | 196 | CATCTGTTCAATC | 276 |
| 512 | ACGAATCTACCCACATCTGTTCAATC | 93 | ACGAATCTACCCA | 196 | CATCTGTTCAATC | 276 |
| 513 | CGAATCTACCCAATCTGTTCAATC | 36 | CGAATCTACCCA | 204 | ATCTGTTCAATC | 261 |
| 514 | CGAATCTACCCAATCTGTTCAATC | 36 | CGAATCTACCCA | 204 | ATCTGTTCAATC | 261 |
| 515 | CGAATCTACCCAATCTGTTCAATC | 36 | CGAATCTACCCA | 204 | ATCTGTTCAATC | 261 |
| 516 | CGAATCTACCCAATCTGTTCAATC | 36 | CGAATCTACCCA | 204 | ATCTGTTCAATC | 261 |
| 517 | CGAATCTACCCACCTGTTCAATCA | 391 | CGAATCTACCCAC | 192 | CTGTTCAATCA | 272 |
| 518 | CGAATCTACCCACATCTGTTCAAT | 111 | CGAATCTACCCAC | 192 | ATCTGTTCAAT | 273 |
| 519 | CGAATCTACCCACTCTGTTCAATC | 392 | CGAATCTACCCAC | 192 | TCTGTTCAATC | 279 |
| 520 | CGAATCTACCCAATCTGTTCAATCA | 393 | CGAATCTACCCA | 204 | ATCTGTTCAATCA | 247 |
| 521 | CGAATCTACCCACTCTGTTCAATCA | 394 | CGAATCTACCCAC | 192 | TCTGTTCAATCA | 260 |
| 522 | ACGAATCTACCCCATCTGTTCAATC | 395 | ACGAATCTACCC | 205 | CATCTGTTCAATC | 276 |
| 523 | ACGAATCTACCCAATCTGTTCAATC | 396 | ACGAATCTACCCA | 196 | ATCTGTTCAATC | 261 |
| 524 | CACGAATCTACCCTGTTCAATCATTC | 397 | CACGAATCTACCC | 191 | TGTTCAATCATTC | 194 |
| 525 | ACGAATCTACCCATGTTCAATCATTC | 398 | ACGAATCTACCCA | 196 | TGTTCAATCATTC | 194 |
| 526 | CCACGAATCTACCCTGTTCAATCATT | 399 | CCACGAATCTACC | 193 | CTGTTCAATCATT | 288 |
| 527 | ACGAATCTACCCACTGTTCAATCATT | 400 | ACGAATCTACCCA | 196 | CTGTTCAATCATT | 288 |
| 528 | CCACGAATCTACCCATCTGTTCAATC | 401 | CCACGAATCTACC | 193 | CATCTGTTCAATC | 276 |
| 529 | CGAATCTACCCAATCTGTTCAATC | 36 | CGAATCTACCCA | 204 | ATCTGTTCAATC | 261 |
| 530 | CGAATCTACCCAATCTGTTCAATC | 36 | CGAATCTACCCA | 204 | ATCTGTTCAATC | 261 |
| 531 | CGAATCTACCCAATCTGTTCAATC | 36 | CGAATCTACCCA | 204 | ATCTGTTCAATC | 261 |
| 532 | CGAATCTACCCAATCTGTTCAATC | 36 | CGAATCTACCCA | 204 | ATCTGTTCAATC | 261 |
| 533 | CGAATCTACCCAATCTGTTCAATC | 36 | CGAATCTACCCA | 204 | ATCTGTTCAATC | 261 |
| 534 | CGAATCTACCCAATCTGTTCAATC | 36 | CGAATCTACCCA | 204 | ATCTGTTCAATC | 261 |
| 535 | CGAATCTACCCAATCTGTTCAATC | 36 | CGAATCTACCCA | 204 | ATCTGTTCAATC | 261 |
| 536 | CGAATCTACCCAATCTGTTCAATC | 36 | CGAATCTACCCA | 204 | ATCTGTTCAATC | 261 |
| 537 | CGAATCTACCCAATCTGTTCAATC | 36 | CGAATCTACCCA | 204 | ATCTGTTCAATC | 261 |
| 538 | CGAATCTACCCAATCTGTTCAATC | 36 | CGAATCTACCCA | 204 | ATCTGTTCAATC | 261 |
| 539 | AGCCACGAATCTGTTCAATC | 402 | AGCCACGA | | ATCTGTTCAATC | 261 |
| 540 | CCACCAACTCATTCATCTGT | 403 | CCACCAACTC | 510 | ATTCATCTGT | 522 |
| 541 | CGAATCTACCCACATCTGTTCAATCA | 2 | CGAATCTACCCAC | 192 | ATCTGTTCAATCA | 247 |
| 542 | CGAATCTACCCACATCTGTTCAATCA | 2 | CGAATCTACCCAC | 192 | ATCTGTTCAATCA | 247 |
| 543 | CGAATCTACCCACATCTGTTCAATCA | 2 | CGAATCTACCCAC | 192 | ATCTGTTCAATCA | 247 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 544 | CGAATCTACCCACATCTGTTCAATCA | 2 | CGAATCTACCCAC | 192 | ATCTGTTCAATCA | 247 |
| 545 | CGAATCTACCCACATCTGTTCAATCA | 2 | CGAATCTACCCAC | 192 | ATCTGTTCAATCA | 247 |
| 546 | CGAATCTACCCACATCTGTTCAATCA | 2 | CGAATCTACCCAC | 192 | ATCTGTTCAATCA | 247 |
| 547 | CGAATCTACCCACATCTGTTCAATCA | 2 | CGAATCTACCCAC | 192 | ATCTGTTCAATCA | 247 |
| 548 | CGAATCTACCCACATCTGTTCAATCA | 2 | CGAATCTACCCAC | 192 | ATCTGTTCAATCA | 247 |
| 549 | CGAATCTACCCACATCTGTTCAATCA | 2 | CGAATCTACCCAC | 192 | ATCTGTTCAATCA | 247 |
| 550 | CGAATCTACCCACATCTGTTCAATCA | 2 | CGAATCTACCCAC | 192 | ATCTGTTCAATCA | 247 |
| 551 | CGAATCTACCCACATCTGTTCAATCA | 2 | CGAATCTACCCAC | 192 | ATCTGTTCAATCA | 247 |
| 552 | CGAATCTACCCACATCTGTTCAATCA | 2 | CGAATCTACCCAC | 192 | ATCTGTTCAATCA | 247 |
| 553 | CGAATCTACCCACATCTGTTCAATCA | 2 | CGAATCTACCCAC | 192 | ATCTGTTCAATCA | 247 |
| 554 | CGAATCTACCCACATCTGTTCAATCA | 2 | CGAATCTACCCAC | 192 | ATCTGTTCAATCA | 247 |
| 555 | CGAATCTACCCACATCTGTTCAATCA | 2 | CGAATCTACCCAC | 192 | ATCTGTTCAATCA | 247 |
| 556 | CGAATCTACCCACATCTGTTCAATCA | 2 | CGAATCTACCCAC | 192 | ATCTGTTCAATCA | 247 |
| 557 | CGAATCTACCCACATCTGTTCAATCA | 2 | CGAATCTACCCAC | 192 | ATCTGTTCAATCA | 247 |
| 558 | CGAATCTACCCACATCTGTTCAATCA | 2 | CGAATCTACCCAC | 192 | ATCTGTTCAATCA | 247 |
| 559 | CGAATCTACCCACATCTGTTCAATCA | 2 | CGAATCTACCCAC | 192 | ATCTGTTCAATCA | 247 |
| 560 | CGAATCTACCCACATCTGTTCAATCA | 2 | CGAATCTACCCAC | 192 | ATCTGTTCAATCA | 247 |
| 561 | CGAATCTACCCACATCTGTTCAATCA | 404 | CGAATCTACCCAC | 192 | ATCTGTTCAATCA | 247 |
| 562 | CGAATCTACCCACATCTGTTCAATCA | 2 | CGAATCTACCCAC | 192 | ATCTGTTCAATCA | 247 |
| 563 | ACGAATCTACCCACATCTGTTCAATC | 93 | ACGAATCTACCCA | 196 | CATCTGTTCAATC | 276 |
| 564 | CGAATCTACCCACATCTGTTCAATCA | 2 | CGAATCTACCCAC | 192 | ATCTGTTCAATCA | 247 |
| 565 | ACGAATCTACCCACATCTGTTCAATC | 93 | ACGAATCTACCCA | 196 | CATCTGTTCAATC | 276 |
| 566 | CCATCCATCATCTGTTCAAT | 405 | CCATCCATCA | 511 | TCTGTTCAAT | 523 |
| 567 | CCATCCATGTACTGTTCAAT | 406 | CCATCCATGTACT | 246 | GTTCAAT | |
| 568 | CCATCCATGTACTTTCAATC | 407 | CCATCCATGTACT | 246 | TTCAATC | |
| 569 | CCATCCATGTACTTCAATCA | 408 | CCATCCATGTACT | 246 | TCAATCA | |
| 570 | ACGAATCTACCCAATCCTTTTATCTA | 409 | ACGAATCTACCCA | 196 | ATCCTTTTATCTA | 524 |
| 571 | CGAATCTACCCACATCCTTTTATCTA | 410 | CGAATCTACCCAC | 192 | ATCCTTTTATCTA | 524 |
| 572 | CACGAATCTACCCCTTTTATCTACTC | 411 | CACGAATCTACCC | 191 | CTTTTATCTACTC | 291 |
| 573 | ACGAATCTACCCATCCTTTTATCTAC | 412 | ACGAATCTACCCA | 196 | TCCTTTTATCTAC | 290 |
| 574 | ACGAATCTACCCACTTTTATCTACTC | 413 | ACGAATCTACCCA | 196 | CTTTTATCTACTC | 291 |
| 575 | CACGAATCTACCCATCCTTTTATCTA | 414 | CACGAATCTACCC | 191 | ATCCTTTTATCTA | 524 |
| 576 | CCATCCATGTACTTTTTATC | 415 | CCATCCATGTACT | 246 | TTTTATC | |
| 577 | CCATCCATGTACTCTTTTAT | 416 | CCATCCATGTACT | 246 | CTTTTAT | |
| 578 | CCATCCATGTACTTGTACTC | 417 | CCATCCATGTACT | 246 | TGTACTC | |
| 579 | CGAATCTACCCACCATCCATGTACTC | 418 | CGAATCTACCCAC | 192 | CATCCATGTACTC | 248 |
| 580 | CGAATCTACCCACATCCATGTACTCA | 419 | CGAATCTACCCAC | 192 | ATCCATGTACTCA | 525 |
| 581 | GCCACGAATCTACTCCATGTACTCAC | 420 | GCCACGAATCTAC | 201 | TCCATGTACTCAC | 526 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 582 | ACGAATCTACCCACATCCATGTACTC | 421 | ACGAATCTACCCA | 196 | CATCCATGTACTC | 248 |
| 583 | ACGAATCTACCCAATCCATGTACTCA | 422 | ACGAATCTACCCA | 196 | ATCCATGTACTCA | 525 |
| 584 | CGAATCTACCCACTCCATGTACTCAC | 423 | CGAATCTACCCAC | 192 | TCCATGTACTCAC | 526 |
| 585 | CACGAATCTACCCCATCCATGTACTC | 3 | CACGAATCTACCC | 191 | CATCCATGTACTC | 248 |
| 586 | ACGAATCTACCCATCCATGTACTC | 424 | ACGAATCTACCC | 205 | ATCCATGTACTC | 527 |
| 587 | ACGAATCCATCCATGTACTC | 425 | ACGAATC | | CATCCATGTACTC | 248 |
| 588 | ACGAATCATCCATGTACTCA | 426 | ACGAATC | | ATCCATGTACTCA | 525 |
| 589 | CGAATCTCATCCATGTACTC | 427 | CGAATCT | | CATCCATGTACTC | 248 |
| 590 | CGAATCTATCCATGTACTCA | 428 | CGAATCT | | ATCCATGTACTCA | 525 |
| 591 | GAATCTACATCCATGTACTC | 429 | GAATCTA | | CATCCATGTACTC | 248 |
| 592 | AATCTACCATCCATGTACTC | 430 | AATCTAC | | CATCCATGTACTC | 248 |
| 593 | ACGAATCCATCCATGTACTC | 425 | ACGAATC | | CATCCATGTACTC | 248 |
| 594 | ACGAATCCATCCATGTACTC | 425 | ACGAATC | | CATCCATGTACTC | 248 |
| 595 | GAATCTACCCATCTCTCCAT | 431 | GAATCTA | | CCCATCTCTCCAT | 528 |
| 596 | TCCATCATCCATGTACTCAC | 432 | TCCATCATCC | 512 | ATGTACTCAC | 529 |
| 597 | GAATCTACCCATCCATGTAC | 433 | GAATCTACCC | 513 | ATCCATGTAC | 271 |
| 598 | CGAATCTACCATCCATGTAC | 82 | CGAATCTACC | 212 | ATCCATGTAC | 271 |
| 599 | CGAATCTACCATCCATGTAC | 82 | CGAATCTACC | 212 | ATCCATGTAC | 271 |
| 600 | CGAATCTACCATCCATGTAC | 82 | CGAATCTACC | 212 | ATCCATGTAC | 271 |
| 601 | CGAATCTACCATCCATGTAC | 82 | CGAATCTACC | 212 | ATCCATGTAC | 271 |
| 602 | CCATCCATGTACTTCACCCA | 434 | CCATCCATGTACT | 246 | TCACCCA | |
| 603 | CAATCATCCATCCATGTACT | 435 | CAATCAT | | CCATCCATGTACT | 246 |
| 604 | CAATCATCCATCCATGTACT | 435 | CAATCAT | | CCATCCATGTACT | 246 |
| 605 | CAATCATCCATCCATGTACT | 435 | CAATCAT | | CCATCCATGTACT | 246 |
| 606 | GTTCAATCCATCCATGTACT | 436 | GTTCAAT | | CCATCCATGTACT | 246 |
| 607 | TTCAATCCCATCCATGTACT | 437 | TTCAATC | | CCATCCATGTACT | 246 |
| 608 | TCAATCACCATCCATGTACT | 438 | TCAATCA | | CCATCCATGTACT | 246 |
| 609 | TTTTATCCCATCCATGTACT | 439 | TTTTATC | | CCATCCATGTACT | 246 |
| 610 | CTTTTATCCATCCATGTACT | 440 | CTTTTAT | | CCATCCATGTACT | 246 |
| 611 | TCACCCACCATCCATGTACT | 441 | TCACCCA | | CCATCCATGTACT | 246 |
| 612 | CCATCCATGTACTCCATCCATGTACT | 442 | CCATCCATGTACT | 246 | CCATCCATGTACT | 246 |
| 613 | CCATCCATGTACT[n6]CCATCCATGTACT | 246/ 246 | CCATCCATGTACT | 246 | CCATCCATGTACT | 246 |
| 614 | CCATCCATCATCC[n6]GGGATAAGAGTTC | 198/ 253 | CCATCCATCATCC | 198 | GGGATAAGAGTTC | 253 |
| 615 | GCCACGAATCTACTCCATCCATGTAC | 445 | GCCACGAATCTAC | 201 | TCCATCCATGTAC | 530 |
| 616 | GCCACGAATCTACCCATCCATGTACT | 446 | GCCACGAATCTAC | 201 | CCATCCATGTACT | 246 |
| 617 | CACGAATCTACCCTCCATCCATGTAC | 447 | CACGAATCTACCC | 191 | TCCATCCATGTAC | 530 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 618 | ACGAATCTACCCACCATCCATGTACT | 448 | ACGAATCTACCCA | 196 | CCATCCATGTACT | 246 |
| 619 | CCACGAATCTACCCCATCCATGTACT | 449 | CCACGAATCTACC | 193 | CCATCCATGTACT | 246 |
| 620 | CACGAATCTACCCCCATCCATGTACT | 1 | CACGAATCTACCC | 191 | CCATCCATGTACT | 246 |
| 621 | CACGAATCTACCCCCATCCATGTACT | 1 | CACGAATCTACCC | 191 | CCATCCATGTACT | 246 |
| 622 | ACGAATCTACCCCCATCCATGTAC | 37 | ACGAATCTACCC | 205 | CCATCCATGTAC | 262 |
| 623 | ACGAATCTACCCCCATCCATGTAC | 37 | ACGAATCTACCC | 205 | CCATCCATGTAC | 262 |
| 624 | ACGAATCTACCCCCATCCATGTAC | 37 | ACGAATCTACCC | 205 | CCATCCATGTAC | 262 |
| 625 | ACGAATCTACCCCCATCCATGTAC | 37 | ACGAATCTACCC | 205 | CCATCCATGTAC | 262 |
| 626 | ACGAATCTACCCCCATCCATGTAC | 37 | ACGAATCTACCC | 205 | CCATCCATGTAC | 262 |
| 627 | ACGAATCTATCCATCCATGTAC | 450 | ACGAATCTA | | TCCATCCATGTAC | 530 |
| 628 | CGAATCTACCCACCCATCCATGTACT | 451 | CGAATCTACCCAC | 192 | CCATCCATGTACT | 246 |
| 629 | ACGAATCCCATCCATGTACT | 452 | ACGAATC | | CCATCCATGTACT | 246 |
| 630 | GCCACGACCATCCATGTACT | 453 | GCCACGA | | CCATCCATGTACT | 246 |
| 631 | CGAATCTCCATCCATGTACT | 454 | CGAATCT | | CCATCCATGTACT | 246 |
| 632 | GAATCTACCATCCATGTACT | 455 | GAATCTA | | CCATCCATGTACT | 246 |
| 633 | AATCTACCCATCCATGTACT | 456 | AATCTAC | | CCATCCATGTACT | 246 |
| 634 | ACGAATCTCCATCCATGTAC | 457 | ACGAATC | | TCCATCCATGTAC | 530 |
| 635 | CGAATCTTCCATCCATGTAC | 458 | CGAATCT | | TCCATCCATGTAC | 530 |
| 636 | GAATCTATCCATCCATGTAC | 459 | GAATCTA | | TCCATCCATGTAC | 530 |
| 637 | GAATCTACCATCCATGTACT | 455 | ACGAATCTAC | 243 | CCATCCATGTACT | 246 |
| 638 | GAATCTACCATCCATGTACT | 455 | ACGAATCTAC | 243 | CCATCCATGTACT | 246 |
| 639 | GAATCTACCATCCATGTACT | 455 | ACGAATCTAC | 243 | CCATCCATGTACT | 246 |
| 640 | GAATCTACCATCCATGTACT | 455 | ACGAATCTAC | 243 | CCATCCATGTACT | 246 |
| 641 | GAATCTACCATCCATGTACT | 455 | ACGAATCTAC | 243 | CCATCCATGTACT | 246 |
| 642 | GAATCTACCATCCATGTACT | 455 | ACGAATCTAC | 243 | CCATCCATGTACT | 246 |
| 643 | GAATCTACCATCCATGTACT | 455 | ACGAATCTAC | 243 | CCATCCATGTACT | 246 |
| 644 | GAATCTACCATCCATGTACT | 455 | ACGAATCTAC | 243 | CCATCCATGTACT | 246 |
| 645 | CGAATCTACCATCCATGTAC | 82 | CGAATCTACC | 212 | ATCCATGTAC | 271 |
| 646 | CGAATCTACCATCCATGTAC | 82 | CGAATCTACC | 212 | ATCCATGTAC | 271 |
| 647 | ACGAATCTCCATCCATGTAC | 457 | ACGAATC | | TCCATCCATGTAC | 530 |
| 648 | ACGAATCTCCATCCATGTAC | 457 | ACGAATC | | TCCATCCATGTAC | 530 |
| 649 | ACGAATCCCATCCATGTACT | 452 | ACGAATC | | CCATCCATGTACT | 246 |
| 650 | CGAATCTCCATCCATGTACT | 454 | CGAATCT | | CCATCCATGTACT | 246 |
| 651 | CGAATCTCCATCCATGTACT | 454 | CGAATCT | | CCATCCATGTACT | 246 |
| 652 | GAATCTACCATCCATGTACT | 455 | GAATCTA | | CCATCCATGTACT | 246 |
| 653 | GAATCTACCATCCATGTACT | 455 | GAATCTA | | CCATCCATGTACT | 246 |
| 654 | GAATCTACCATCCATGTACT | 455 | GAATCTA | | CCATCCATGTACT | 246 |
| 655 | GAATCTACCATCCATGTACT | 455 | GAATCTA | | CCATCCATGTACT | 246 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 656 | GAATCTACCATCCATGTACT | 455 | GAATCTA | | CCATCCATGTACT | 246 |
| 657 | GAATCTACCATCCATGTACT | 455 | GAATCTA | | CCATCCATGTACT | 246 |
| 658 | GAATCTACCATCCATGTACT | 455 | GAATCTA | | CCATCCATGTACT | 246 |
| 659 | GAATCTACCATCCATGTAC | 460 | GAATCTA | | CCATCCATGTAC | 262 |
| 660 | GAATCTACCATCCATGTACT | 455 | GAATCTA | | CCATCCATGTACT | 246 |
| 661 | GAATCTACCATCCATGTACT | 455 | GAATCTA | | CCATCCATGTACT | 246 |
| 662 | GAATCTACCATCCATGTACT | 455 | GAATCTA | | CCATCCATGTACT | 246 |
| 663 | GAATCTACCCATCCATGTACT | 461 | GAATCTAC | | CCATCCATGTACT | 246 |
| 664 | CGAATCTACCATCCATGTACT | 462 | CGAATCTA | | CCATCCATGTACT | 246 |
| 665 | ACGAATCTACCATCCATGTACT | 463 | ACGAATCTA | | CCATCCATGTACT | 246 |
| 666 | CACGAATCTACCATCCATGTACT | 464 | CACGAATCTA | 245 | CCATCCATGTACT | 246 |
| 667 | CCACGAATCTACCATCCATGTACT | 465 | CCACGAATCTA | 514 | CCATCCATGTACT | 246 |
| 668 | CCACGAATCTACCATCCATGTACT | 465 | CCACGAATCTA | 514 | CCATCCATGTACT | 246 |
| 669 | GAATCTACCATCCATGTACT | 455 | GAATCTA | | CCATCCATGTACT | 246 |
| 670 | GAATCTACCATCCATGTACT | 455 | GAATCTA | | CCATCCATGTACT | 246 |
| 671 | GAATCTACCATCCATGTACT | 455 | GAATCTA | | CCATCCATGTACT | 246 |
| 672 | GAATCTACCATCCATGTACT | 455 | GAATCTA | | CCATCCATGTACT | 246 |
| 673 | GAATCTACCATCCATGTACT | 455 | GAATCTA | | CCATCCATGTACT | 246 |
| 674 | GAATCTACCATCCATGTACT | 455 | GAATCTA | | CCATCCATGTACT | 246 |
| 675 | GAATCTACCATCCATGTACT | 455 | GAATCTA | | CCATCCATGTACT | 246 |
| 676 | GAATCTACCATCCATGTACT | 455 | GAATCTA | | CCATCCATGTACT | 246 |
| 677 | GAATCTACCATCCATGTACT | 455 | GAATCTA | | CCATCCATGTACT | 246 |
| 678 | GAATCTACCATCCATGTACT | 455 | GAATCTA | | CCATCCATGTACT | 246 |
| 679 | GAATCTACCATCCATGTACT | 455 | GAATCTA | | CCATCCATGTACT | 246 |
| 680 | GAATCTACCATCCATGTACT | 455 | GAATCTA | | CCATCCATGTACT | 246 |
| 681 | GAATCTACCATCCATGTACT | 455 | GAATCTA | | CCATCCATGTACT | 246 |
| 682 | GAATCTACCATCCATGTACT | 455 | GAATCTA | | CCATCCATGTACT | 246 |
| 683 | GAATCTACCATCCATGTACT | 455 | GAATCTA | | CCATCCATGTACT | 246 |
| 684 | GAATCTACCATCCATGTACT | 455 | GAATCTA | | CCATCCATGTACT | 246 |
| 685 | GAATCTACCATCCATGTACT | 455 | GAATCTA | | CCATCCATGTACT | 246 |
| 686 | GAATCTACCATCCATGTACT | 455 | GAATCTA | | CCATCCATGTACT | 246 |
| 687 | GAATCTACCATCCATGTACT | 455 | GAATCTA | | CCATCCATGTACT | 246 |
| 688 | GAATCTACCATCCATGTACT | 455 | GAATCTA | | CCATCCATGTACT | 246 |
| 689 | GAATCTACCATCCATGTACT | 455 | GAATCTA | | CCATCCATGTACT | 246 |
| 690 | GAATCTACCATCCATGTACT | 455 | GAATCTA | | CCATCCATGTACT | 246 |
| 691 | GAATCTACCATCCATGTACT | 455 | GAATCTA | | CCATCCATGTACT | 246 |
| 692 | GAATCTACCATCCATGTACT | 455 | GAATCTA | | CCATCCATGTACT | 246 |

TABLE 9-continued

| Nucleobase sequences of antisense oligonucleotides provided herein | | | | | | |
|---|---|---|---|---|---|---|
| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
| 693 | GAATCTACCATCCATGTACT | 455 | GAATCTA | | CCATCCATGTACT | 246 |
| 694 | GAATCTACCATCCATGTACT | 455 | GAATCTA | | CCATCCATGTACT | 246 |
| 695 | GAATCTACCATCCATGTACT | 455 | GAATCTA | | CCATCCATGTACT | 246 |
| 696 | GAATCTACCATCCATGTACT | 455 | GAATCTA | | CCATCCATGTACT | 246 |
| 697 | GAATCTACCATCCATGTACT | 455 | GAATCTA | | CCATCCATGTACT | 246 |
| 698 | GAATCTACCATCCATGTACT | 455 | GAATCTA | | CCATCCATGTACT | 246 |
| 699 | GAATCTACCATCCATGTACT | 455 | GAATCTA | | CCATCCATGTACT | 246 |
| 700 | GAATCTACCATCCATGTACT | 455 | GAATCTA | | CCATCCATGTACT | 246 |
| 701 | GAATCTACCATCCATGTACT | 455 | GAATCTA | | CCATCCATGTACT | 246 |
| 702 | GAATCTACCATCCATGTACT | 455 | GAATCTA | | CCATCCATGTACT | 246 |
| 703 | GAATCTACCATCCATGTACT | 455 | GAATCTA | | CCATCCATGTACT | 246 |
| 704 | GAATCTACCATCCATGTACT | 455 | GAATCTA | | CCATCCATGTACT | 246 |
| 705 | GAATCTACCATCCATGTACT | 455 | GAATCTA | | CCATCCATGTACT | 246 |
| 706 | GAATCTACCCATCCATGTACT | 461 | GAATCTAC | | CCATCCATGTACT | 246 |
| 707 | GAATCTACCCATCCATGTACT | 461 | GAATCTAC | | CCATCCATGTACT | 246 |
| 708 | GAATCTACCCATCCATGTACT | 461 | GAATCTAC | | CCATCCATGTACT | 246 |
| 709 | GAATCTACCCATCCATGTACT | 461 | GAATCTAC | | CCATCCATGTACT | 246 |
| 710 | GAATCTACCCATCCATGTACT | 461 | GAATCTAC | | CCATCCATGTACT | 246 |
| 711 | GAATCTACCCATCCATGTACT | 461 | GAATCTAC | | CCATCCATGTACT | 246 |
| 712 | GAATCTACCCATCCATGTACT | 461 | GAATCTAC | | CCATCCATGTACT | 246 |
| 713 | GAATCTACCCATCCATGTACT | 461 | GAATCTAC | | CCATCCATGTACT | 246 |
| 714 | GAATCTACCCATCCATGTACT | 461 | GAATCTAC | | CCATCCATGTACT | 246 |
| 715 | GAATCTACCCATCCATGTACT | 461 | GAATCTAC | | CCATCCATGTACT | 246 |
| 716 | GAATCTACCCATCCATGTACT | 461 | GAATCTAC | | CCATCCATGTACT | 246 |
| 717 | GAATCTACCCATCCATGTACT | 461 | GAATCTAC | | CCATCCATGTACT | 246 |
| 718 | GAATCTACCCATCCATGTACT | 461 | GAATCTAC | | CCATCCATGTACT | 246 |
| 719 | GAATCTACCCATCCATGTACT | 461 | GAATCTAC | | CCATCCATGTACT | 246 |
| 720 | GAATCTACCCATCCATGTACT | 461 | GAATCTAC | | CCATCCATGTACT | 246 |
| 721 | GAATCTACCCATCCATGTACT | 461 | GAATCTAC | | CCATCCATGTACT | 246 |
| 722 | GAATCTACCCATCCATGTACT | 461 | GAATCTAC | | CCATCCATGTACT | 246 |
| 723 | GAATCTACCCATCCATGTACT | 461 | GAATCTAC | | CCATCCATGTACT | 246 |
| 724 | GAATCTACCCATCCATGTACT | 461 | GAATCTAC | | CCATCCATGTACT | 246 |
| 725 | GAATCTACCCATCCATGTACT | 461 | GAATCTAC | | CCATCCATGTACT | 246 |
| 726 | GAATCTACCCATCCATGTACT | 461 | GAATCTAC | | CCATCCATGTACT | 246 |
| 727 | GAATCTACCCATCCATGTACT | 461 | GAATCTAC | | CCATCCATGTACT | 246 |
| 728 | GAATCTACCCATCCATGTACT | 461 | GAATCTAC | | CCATCCATGTACT | 246 |
| 729 | GAATCTACCCATCCATGTACT | 461 | GAATCTAC | | CCATCCATGTACT | 246 |
| 730 | GAATCTACCATCCATGTACT | 455 | GAATCTA | | CCATCCATGTACT | 246 |

TABLE 9-continued

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 731 | GAATCTACCATCCATGTACT | 455 | GAATCTA | | CCATCCATGTACT | 246 |
| 732 | GAATCTACCATCCATGTACT | 455 | GAATCTA | | CCATCCATGTACT | 246 |
| 733 | GAATCTACCATCCATGTACT | 455 | GAATCTA | | CCATCCATGTACT | 246 |
| 734 | GAATCTACCATCCATGTACT | 455 | GAATCTA | | CCATCCATGTACT | 246 |
| 735 | GAATCTACCATCCATGTACT | 455 | GAATCTA | | CCATCCATGTACT | 246 |
| 736 | GAATCTACCCATCCATGTACT | 461 | GAATCTAC | | CCATCCATGTACT | 246 |
| 737 | GAATCTACCCATCCATGTACT | 461 | GAATCTAC | | CCATCCATGTACT | 246 |
| 738 | GAATCTACCCATCCATGTACT | 461 | GAATCTAC | | CCATCCATGTACT | 246 |
| 739 | GAATCTACCATCCATGTACT | 455 | GAATCTA | | CCATCCATGTACT | 246 |
| 740 | GAATCTACCATCCATGTACT | 455 | GAATCTA | | CCATCCATGTACT | 246 |
| 741 | GAATCTACCATCCATGTACT | 455 | GAATCTA | | CCATCCATGTACT | 246 |
| 742 | GAATCTACCATCCATGTACT | 455 | GAATCTA | | CCATCCATGTACT | 246 |
| 743 | GAATCTACCATCCATGTACT | 455 | GAATCTA | | CCATCCATGTACT | 246 |
| 744 | GAATCTACCCATCCATGTACT | 461 | GAATCTAC | | CCATCCATGTACT | 246 |
| 745 | GAATCTACCCATCCATGTACT | 461 | GAATCTAC | | CCATCCATGTACT | 246 |
| 746 | GAATCTACCCATCCATGTACT | 461 | GAATCTAC | | CCATCCATGTACT | 246 |
| 747 | GAATCTACCCATCCATGTACT | 461 | GAATCTAC | | CCATCCATGTACT | 246 |
| 748 | GAATCTACCCATCCATGTACT | 461 | GAATCTAC | | CCATCCATGTACT | 246 |
| 749 | GAATCTACCCATCCATGTACT | 461 | GAATCTAC | | CCATCCATGTACT | 246 |
| 750 | GAATCTACCCATCCATGTACT | 461 | GAATCTAC | | CCATCCATGTACT | 246 |
| 751 | GAATCTACCATCCATGTACT | 466 | GAATCTA | | CCATCCATGTACT | 246 |
| 752 | GAATCTACCCATCCATGTACT | 467 | GAATCTAC | | CCATCCATGTACT | 246 |
| 753 | GAATCTACCATCCATGTACT | 455 | GAATCTA | | CCATCCATGTACT | 246 |
| 754 | GAATCTACCATCCATGTACT | 455 | GAATCTA | | CCATCCATGTACT | 246 |
| 755 | GAATCTACCCATCCATGTACT | 461 | GAATCTAC | | CCATCCATGTACT | 246 |
| 756 | GAATCTACCCATCCATGTACT | 461 | GAATCTAC | | CCATCCATGTACT | 246 |
| 757 | CGAATCTACCCATCCATGTACT | 468 | CGAATCTAC | | CCATCCATGTACT | 246 |
| 758 | GAATCTACCCCATCCATGTACT | 469 | GAATCTACC | | CCATCCATGTACT | 246 |
| 759 | ACGAATCTACCCATCCATGTACT | 470 | ACGAATCTAC | 243 | CCATCCATGTACT | 246 |
| 760 | CGAATCTACCCCATCCATGTACT | 471 | CGAATCTACC | 212 | CCATCCATGTACT | 246 |
| 761 | GAATCTACCCCCATCCATGTACT | 472 | GAATCTACCC | 513 | CCATCCATGTACT | 246 |
| 762 | CACGAATCTACCCATCCATGTACT | 115 | CACGAATCTAC | 515 | CCATCCATGTACT | 246 |
| 763 | CGAATCTACCCCCATCCATGTACT | 473 | CGAATCTACCC | 214 | CCATCCATGTACT | 246 |
| 764 | GAATCTACCCACCATCCATGTACT | 474 | GAATCTACCCA | 218 | CCATCCATGTACT | 246 |
| 765 | CGAATCTACATCCATGTACT | 475 | CGAATCTA | | CATCCATGTACT | 264 |
| 766 | ACGAATCTACATCCATGTAC | 476 | ACGAATCTA | | CATCCATGTAC | 531 |
| 767 | GAATCTACCCCATCCATGTA | 477 | GAATCTACC | | CCATCCATGTA | 532 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 768 | CACGAATCTATCCATGTACT | 478 | CACGAATCTA | 245 | TCCATGTACT | 533 |
| 769 | CACGAATCTAATCCATGTAC | 479 | CACGAATCTA | 245 | ATCCATGTAC | 271 |
| 770 | CACGAATCTACATCCATGTA | 480 | CACGAATCTA | 245 | CATCCATGTA | 303 |
| 771 | GAATCTACCCCCATCCATGT | 481 | GAATCTACCC | 513 | CCATCCATGT | 301 |
| 772 | GAATCTACCATCCATGTACT | 455 | GAATCTA | | CCATCCATGTACT | 246 |
| 773 | GAATCTACCATCCATGTACT | 455 | GAATCTA | | CCATCCATGTACT | 246 |
| 774 | GAATCTACCATCCATGTACT | 455 | GAATCTA | | CCATCCATGTACT | 246 |
| 775 | GAATCTACCATCCATGTACT | 455 | GAATCTA | | CCATCCATGTACT | 246 |
| 776 | GAATCTACCATCCATGTACT | 455 | GAATCTA | | CCATCCATGTACT | 246 |
| 777 | GAATCTACCATCCATGTACT | 455 | GAATCTA | | CCATCCATGTACT | 246 |
| 778 | GAATCTACCATCCATGTACT | 455 | GAATCTA | | CCATCCATGTACT | 246 |
| 779 | GAATCTACCATCCATGTACT | 455 | GAATCTA | | CCATCCATGTACT | 246 |
| 780 | GAATCTACCATCCATGTACT | 455 | GAATCTA | | CCATCCATGTACT | 246 |
| 781 | GAATCTACCCATCCATGTACT | 461 | GAATCTAC | | CCATCCATGTACT | 246 |
| 782 | GAATCTACCCATCCATGTACT | 461 | GAATCTAC | | CCATCCATGTACT | 246 |
| 783 | GAATCTACCCATCCATGTACT | 461 | GAATCTAC | | CCATCCATGTACT | 246 |
| 784 | GAATCTACCCATCCATGTACT | 461 | GAATCTAC | | CCATCCATGTACT | 246 |
| 785 | GAATCTACCCATCCATGTACT | 461 | GAATCTAC | | CCATCCATGTACT | 246 |
| 786 | GAATCTACCCATCCATGTACT | 461 | GAATCTAC | | CCATCCATGTACT | 246 |
| 787 | GAATCTACCCATCCATGTACT | 461 | GAATCTAC | | CCATCCATGTACT | 246 |
| 788 | GAATCTACACATCCATGTACT | 482 | GAATCTAC | | CCATCCATGTACT | 246 |
| 789 | GAATCTACACATCCATGTACT | 482 | GAATCTAC | | CCATCCATGTACT | 246 |
| 790 | GAATCTACACATCCATGTACT | 482 | GAATCTAC | | CCATCCATGTACT | 246 |
| 791 | GAATCTACACATCCATGTACT | 482 | GAATCTAC | | CCATCCATGTACT | 246 |
| 792 | GAATCTACCCATCCATGTACT | 461 | GAATCTAC | | CCATCCATGTACT | 246 |
| 793 | GAATCTACCCATCCATGTACT | 461 | GAATCTAC | | CCATCCATGTACT | 246 |
| 794 | GAATCTACCCATCCATGTACT | 461 | GAATCTAC | | CCATCCATGTACT | 246 |
| 795 | GAATCTACCCATCCATGTACT | 461 | GAATCTAC | | CCATCCATGTACT | 246 |
| 796 | GAATCTA[n3]CCATCCATGTACT | 246 | GAATCTA | | CCATCCATGTACT | 246 |
| 797 | GAATCTA[n6]CCATCCATGTACT | 246 | GAATCTA | | CCATCCATGTACT | 246 |
| 798 | GAATCTA[n3]CCCATCCATGTACT | 534 | GAATCTA | | CCCATCCATGTACT | 534 |
| 799 | GAATCTA[n6]CCCATCCATGTACT | 534 | GAATCTA | | CCCATCCATGTACT | 534 |
| 800 | GAATCTACC[n3]ATCCATGTACT | 535 | GAATCTACC | | ATCCATGTACT | 535 |
| 801 | GAATCTACC[n6]ATCCATGTACT | 535 | GAATCTACC | | ATCCATGTACT | 535 |
| 802 | GAATCTACC[n3]CATCCATGTACT | 264 | GAATCTACC | | CATCCATGTACT | 264 |
| 803 | GAATCTACC[n6]CATCCATGTACT | 264 | GAATCTACC | | CATCCATGTACT | 264 |
| 804 | GAATCTAC[n3]CATCCATGTACT | 264 | GAATCTAC | | CATCCATGTACT | 264 |
| 805 | GAATCTAC[n3]CCATCCATGTACT | 246 | GAATCTAC | | CCATCCATGTACT | 246 |

TABLE 9-continued

Nucleobase sequences of antisense oligonucleotides provided herein

| ASO # | Nucleobase Sequence (5'→3') | SEQ ID NO: | Antisense Sequence 1 (5'→3') | SEQ ID NO: | Antisense Sequence 2 (5'→3') | SEQ ID NO: |
|---|---|---|---|---|---|---|
| 806 | GAATCTAC[n6]CCATCCATGTACT | 246 | GAATCTAC | | CCATCCATGTACT | 246 |
| 807 | GAATCTACCATCCATGTACT | 455 | GAATCTA | | CCATCCATGTACT | 246 |
| 808 | GAATCTACCCATCCATGTACT | 461 | GAATCTAC | | CCATCCATGTACT | 246 |
| 809 | TCTACCCCCATCCATGTACT | 489 | TCTACCC | | CCATCCATGTACT | 246 |
| 810 | ATCTACCCCATCCATGTACT | 490 | ATCTACC | | CCATCCATGTACT | 246 |
| 811 | GTCGCCGCCATCCATGTACT | 491 | GTCGCCG | | CCATCCATGTACT | 246 |
| 812 | GGGGTCGCCATCCATGTACT | 492 | GGGGTCG | | CCATCCATGTACT | 246 |
| 813 | GGGTCGCCCATCCATGTACT | 493 | GGGTCGC | | CCATCCATGTACT | 246 |
| 814 | GGTCGCCCCATCCATGTACT | 494 | GGTCGCC | | CCATCCATGTACT | 246 |

†When C is provided in a nucleobase sequence disclosed herein, without modification, such as in Table 9, it encompasses cytidine or 5'-methyl cytidine ‡Each thymine base (T) in any one of the oligonucleotide sequences provided in Table 9 may independently and optionally be replaced with a uracil base (U).

5

[n3] is a C3 spacer as shown in Table 16.

[n6] is a C6 spacer as shown in Table 16.

Modified Antisense Oligonucleotides

Some aspects of the present disclosure provide modified (e.g., chemically modified) antisense oligonucleotides. For example, any one of the antisense oligonucleotides provided herein (e.g., in Table 3 or Table 9) may comprise one or more chemical modifications including, e.g., one or more modified nucleosides and/or one or more modified nucleosides and/or modified internucleoside linkages.

In some embodiments, an antisense oligonucleotide disclosed herein, comprises a first antisense sequence and a second antisense sequence, and comprises one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, or more) modified nucleosides and/or one or more (e.g., 1, 2, 3, 4, 5, 6, 7, 8, 9, 10, or more) modified internucleoside linkages. In some embodiments, a modified nucleoside comprises a modification at the 2' position of the sugar (referred to herein as a "2'-modified nucleoside"). In some embodiments, a 2'-modified nucleoside is a not bicyclic (referred to herein as "non-bicyclic 2'-modified nucleoside"). In some embodiments, a 2'-modified nucleoside comprises a modification at the 2' position and 4' position of the sugar creating a bridged structure (referred to herein as a "2'-4' bridged nucleoside"). In some embodiments, the one or more modified nucleosides comprise a non-bicyclic 2'-modified nucleoside, a 2'-4' bridged nucleoside, or combinations thereof. In some embodiments, all modified nucleosides in an antisense oligonucleotide are 2'-modified nucleosides. In some embodiments, the non-bicyclic 2'-modified nucleoside is a 2'-O-methoxyethyl (2'-MOE) modified nucleoside, a 2'-O-Methyl (2'-O-Me) nucleoside, or a 2'-fluoro (2'-F) modified nucleoside, and/or the 2'-4' bridged nucleoside is a locked nucleic acid (LNA. 2'-4' methylene bridge), an ethylene-bridged nucleic acid (ENA, 2'-4' ethylene bridge) or an constrained ethyl nucleic acid (cEt, 2'-4' ethylene bridge). In some embodiments, the 2'-modified nucleoside is a 2'-O, 4'-C-Spirocyclopropylene bridged nucleic acid (scpBNA). In some embodiments, the 2'-modified nucleoside is a 2'-O—N-methylacetamide (2'-O-NMA) modified nucleoside. In some embodiments, the 2'-modified nucleoside is an amido-bridged nucleic acid (AmNA). In some embodiments, the 2'-modified nucleoside is a 2'-O, 4'-C-aminomethylene bridged nucleic acid (BNA (NC)). In some embodiments, an antisense oligonucleotide disclosed herein comprises one or more 2'-MOE modified nucleosides. In some embodiments, an antisense oligonucleotide disclosed herein comprises one or more LNAs. In some embodiments, an antisense oligonucleotide disclosed herein comprises one or more 2'-MOE modified nucleosides and one or more LNAs. In some embodiments, each nucleoside of the antisense oligonucleotide is a 2'-MOE modified nucleoside.

In some embodiments, an antisense oligonucleotide disclosed herein comprises one or more (1, 2, 3, 4, 5, 6, 7, 8, 9, 10, 11, 12, or more) of the following 2'-modified nucleosides: 2'-O-Me, 2'-F, 2'-MOE, LNA, ENA, cEt, scpBNA, 2'-O-NMA, AmNA, and BNA (NC). In some embodiments, an antisense oligonucleotide disclosed herein comprises one or more (1, 2, 3, 4, 5, 6, 7, 8, 9, 10, 11, 12, or more) of the following 2'-modified nucleosides: ENA, cEt. scpBNA, 2'-O-NMA, AmNA, and BNA (NC). In some embodiments, each nucleoside in an antisense oligonucleotide disclosed herein is a modified nucleoside (e.g., 2'-modified nucleoside). In some embodiments, one or more (1, 2, 3, 4, 5, 6, 7, 8, 9, 10, 11, 12, or more) of the modified nucleosides are an ENA. In some embodiments, one or more (1, 2, 3, 4, 5, 6, 7, 8, 9, 10, 11, 12, or more) of the modified nucleosides are cEt. In some embodiments, one or more (1, 2, 3, 4, 5, 6, 7, 8, 9, 10, 11, 12, or more) of the modified nucleosides are a scpBNA. In some embodiments, one or more (1, 2, 3, 4, 5, 6, 7, 8, 9, 10, 11, 12, or more) of the modified nucleosides are 2'-O-NMA modified nucleosides. In some embodiments, one or more (1, 2, 3, 4, 5, 6, 7, 8, 9, 10, 11, 12, or more) of the modified nucleosides are an AmNA. In some embodiments, one or more (1, 2, 3, 4, 5, 6, 7, 8, 9, 10, 11, 12, or more) of the modified nucleosides are a BNA (NC). In some embodiments, one or more (1, 2, 3, 4, 5, 6, 7, 8, 9, 10, 11, 12, or more) of the modified nucleosides are selected from the following 2'-modified nucleosides: 2'-O-Me, 2'-F, ENA, cEt, scpBNA, 2'-O-NMA, AmNA, and BNA (NC) and the remaining modified nucleosides are 2'-MOE modified nucleosides, LNAs, or a mix of 2'MOE modified nucleosides and LNAs. In some embodiments, one or more (1, 2, 3, 4, 5, 6, 7, 8, 9, 10, 11, 12, or more) of the modified nucleosides are selected from the following 2'-modified nucleosides: ENA, scpBNA, 2'-O-NMA, AmNA, and BNA (NC) and the remaining modified nucleosides are 2'-MOE modified nucleosides, LNAs, or a mix of 2'MOE modified nucleosides and LNAs. In some embodiments, the remaining modified nucleosides are 2'-MOE modified nucleosides. In some embodiments, the remaining modified nucleosides are LNAs. In some embodiments, one or more (1, 2, 3, 4, 5, 6, 7, 8, 9, 10, 11, 12, or more) of the modified nucleosides are an AmNA and the remaining modified nucleosides are a mix of 2'-MOE modified nucleosides and LNAs. In some embodiments, one or more (1, 2, 3, 4, 5, 6, 7, 8, 9, 10, 11, 12, or more) of the modified nucleosides are an ENA and the remaining modified nucleosides are 2'-MOE modified nucleosides. In some embodiments, one or more (1, 2, 3, 4, 5, 6, 7, 8, 9, 10, 11, 12, or more) of the modified nucleosides are a scpBNA and the remaining modified nucleosides are 2'-MOE modified nucleosides. In some embodiments, one or more (1, 2, 3, 4, 5, 6, 7, 8, 9, 10, 11, 12, or more) of the modified nucleosides are an AmNA and the remaining modified nucleosides are 2'-MOE modified nucleosides. In some embodiments, one or more (1, 2, 3, 4, 5, 6, 7, 8, 9, 10, 11, 12, or more) of the modified nucleosides are a BNA (NC) and the remaining modified nucleosides are 2'-MOE modified nucleosides. In some embodiments, one or more (1, 2, 3, 4, 5, 6, 7, 8, 9, 10, 11, 12, or more) of the modified nucleosides are 2'-O-NMA modified nucleosides and the remaining modified nucleosides are LNAS.

In some embodiments, an antisense oligonucleotide disclosed herein, comprises a first antisense sequence and a second antisense sequence, and comprises one or more (e.g., 1, 2, 3, 4, 5, 6, 7, 8, 9, 10, or more) modified internucleoside linkages. In some embodiments, each internucleoside linkage of the antisense oligonucleotide is a modified internucleoside linkage. Non limiting examples of internucleoside linkages include phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, mesyl phosphoramidates, thionophosphoramidates, thionoalkylphosphonates, thionoalkylphosphotriesters, and boranophosphates. In some embodiments, the antisense oligonucleotide comprises one or more (e.g., 1, 2, 3, 4, 5, 6, 7, 8, 9, 10, or more) phosphorothioate internucleoside linkages. It is to be understood that, in any one of the antisense oligonucleotides disclosed herein, the rest of internucleoside linkages, unless otherwise specified, are all phosphodiester internucleoside linkages. In some embodiments, each internucleoside linkage of the antisense oligonucleotide is a phosphorothioate linkage. In some embodiments, the antisense oligonucleotide comprises a mix of phosphodiester linkages and phosphorothioate linkages. In some embodiments, the antisense oligonucleotide comprises one or more phosphorodiamidate morpholinos. In some embodiments, the antisense oligonucleotide is a phosphorodiamidate morpholino oligomer (PMO).

In some embodiments, an antisense oligonucleotide disclosed herein, comprises a first antisense sequence and a second antisense sequence, wherein each cytosine of the oligonucleotide is a 5-methyl-cytosine. In some embodiments, each cytosine of the oligonucleotide is not a 5-methyl-cytosine. In some embodiments, one or more of the cytosines of the oligonucleotide is a 5-methyl-cytosine.

Table 4 lists various exemplary nucleosides with 3'-phosphate or 3'-phosphorothioate and the structures thereof.

TABLE 4

Exemplary nucleosides with 3'-phosphate or 3'-phosphorothioate and structures

| Abbreviation | Nucleosides or linkage | Structure |
|---|---|---|
| lA | 2'-O,4'-C-methylene bridge adenosine-3'-phosphate | 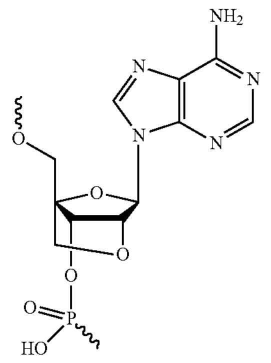 |
| lAs | 2'-O,4'-C-methylene bridge adenosine-3'-phosphorothioate | 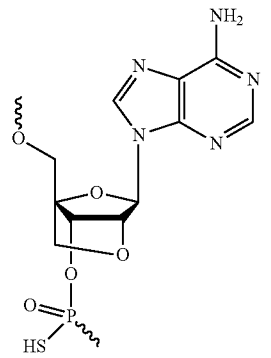 |
| lC | 2'-O,4'-C-methylene bridge cytidine-3'-phosphate | 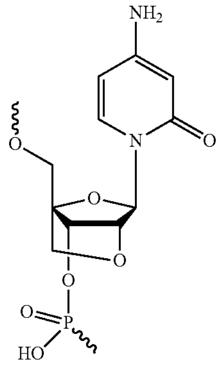 |

TABLE 4-continued

| Exemplary nucleosides with 3'-phosphate or 3'-phosphorothioate and structures | | |
|---|---|---|
| Abbre-viation | Nucleosides or linkage | Structure |
| lCs | 2'-O,4'-C-methylene bridge cytidine-3'-phosphorothioate | 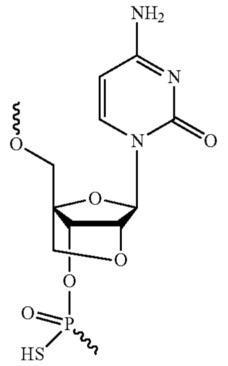 |
| l$^5$C | 2'-O,4'-C-methylene bridge-5'-methyl cytidine-3'-phosphate | 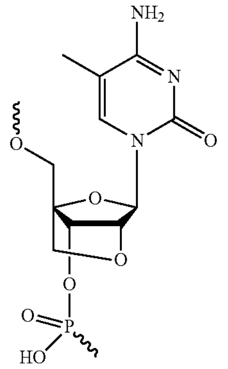 |
| l$^5$Cs | 2'-O,4'-C-methylene bridge-5-methylcytidine-3'-phosphorothioate | 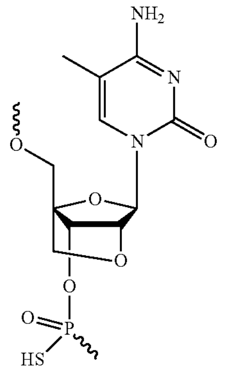 |
| lG | 2'-O,4'-C-methylene bridge guanosine-3'-phosphate | 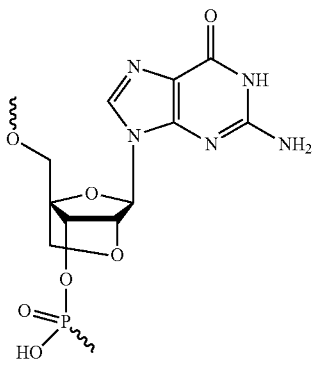 |

TABLE 4-continued

| Exemplary nucleosides with 3'-phosphate or 3'-phosphorothioate and structures | | |
|---|---|---|
| Abbre-viation | Nucleosides or linkage | Structure |
| lGs | 2'-O,4'-C-methylene bridge guanosine-3'-phosphorothioate | 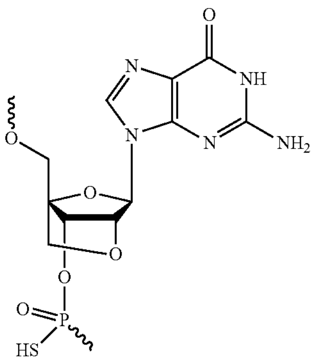 |
| lU | 2'-O,4'-C-methylene bridge uridine-3'-phosphate | 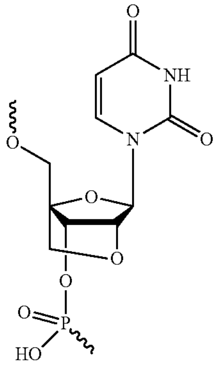 |
| lUs | 2'-O,4'-C-methylene bridge uridine-3'-phosphorothioate | 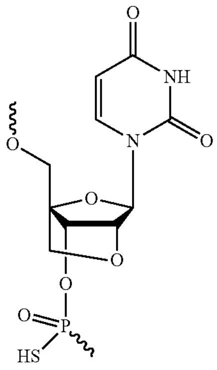 |
| lT | 2'-O,4'-C-methylene bridge thymidine-3'-phosphate | 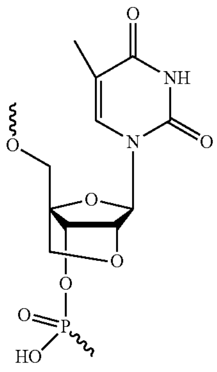 |

TABLE 4-continued

Exemplary nucleosides with 3'-phosphate or 3'-phosphorothioate and structures

| Abbreviation | Nucleosides or linkage | Structure |
|---|---|---|
| lTs | 2'-O,4'-C-methylene bridge thymidine-3'-phosphorothioate | 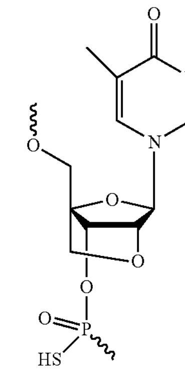 |
| iA | 2'-O-methoxyethyl-adenosine-3'-phosphate | 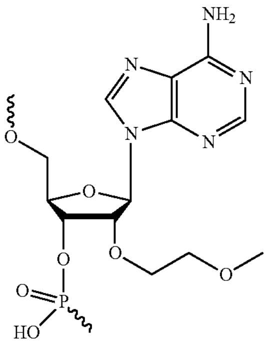 |
| iAs | 2'-O-methoxyethyl-adenosine-3'-phosphorothioate | 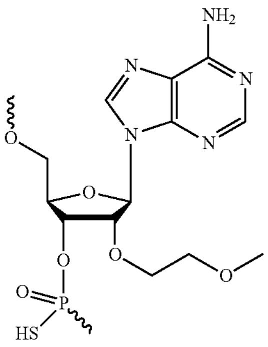 |
| iC | 2'-O-methoxyethyl-cytidine-3'-phosphate | 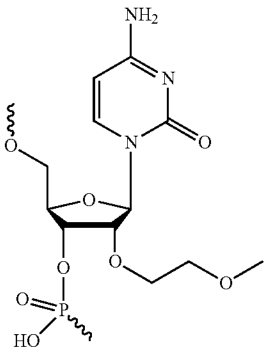 |

TABLE 4-continued

Exemplary nucleosides with 3'-phosphate or 3'-phosphorothioate and structures

| Abbreviation | Nucleosides or linkage | Structure |
|---|---|---|
| iCs | 2'-O-methoxyethyl-cytidine-3'-phosphorothioate | 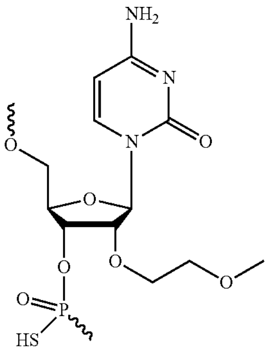 |
| i5C | 2'-O-methoxyethyl-5-methylcytidine-3'-phosphate | 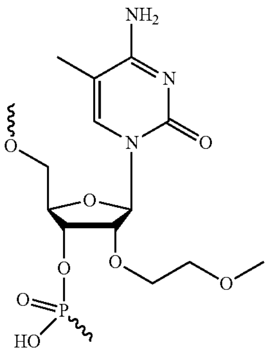 |
| i5Cs | 2'-O-methoxyethyl-5-methylcytidine-3'-phosphorothioate | 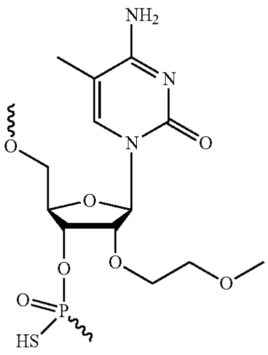 |
| iG | 2'-O-methoxyethyl-guanosine-3'-phosphate | 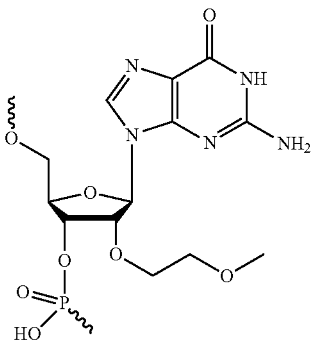 |

TABLE 4-continued

| Exemplary nucleosides with 3'-phosphate or 3'-phosphorothioate and structures | | |
|---|---|---|
| Abbreviation | Nucleosides or linkage | Structure |
| iGs | 2'-O-methoxyethyl-guanosine-3'-phosphorothioate | 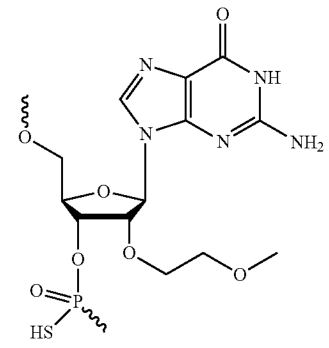 |
| iU | 2'-O-methoxyethyl-luridine-3'-phosphate | 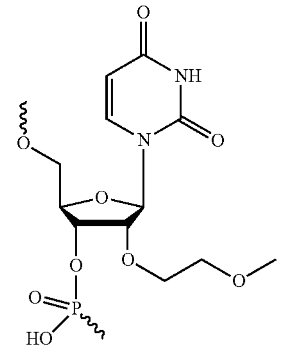 |
| iUs | 2'-O-methoxyethyl-uridine-3'-phosphorothioate | 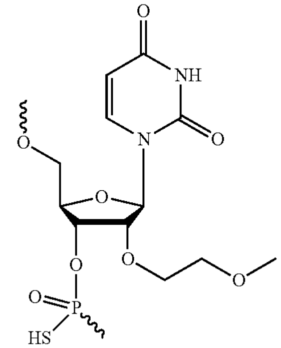 |
| iT | 2'-O-methoxyethyll-thymidine-3'-phosphate | 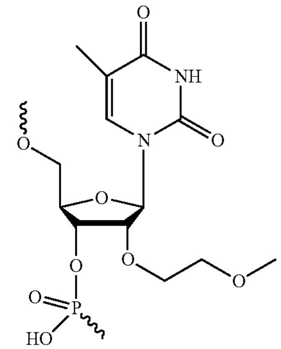 |
| iTs | 2'-O-methoxyethyl-thymidine-3'-phosphorothioate | 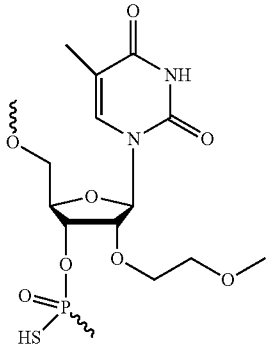 |
| s | Phosphorothioate linkage | 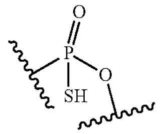 |

TABLE 10

| Additional exemplary modified nucleosides | | |
|---|---|---|
| Abbreviation | Name | Structure |
| z | AmNA | 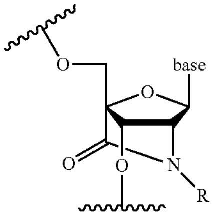 R is Methyl (Me) or H |
| b | BNA(NC) | 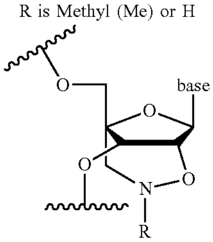 R is Methyl (Me) or H |
| ena | ENA | |
| scp | scpBNA | 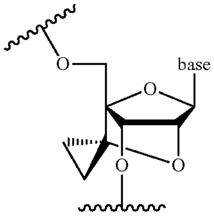 |

TABLE 10-continued

| Additional exemplary modified nucleosides | | |
|---|---|---|
| Abbreviation | Name | Structure |
| nma | 2'-O-NMA | 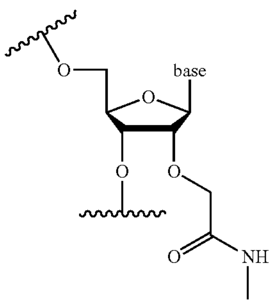 |

*"base" represents any nucleobase or derivative thereof tion of 2'-MOE modified nucleosides and one or more (e.g., 1, 2, 3, or 4) BNA (NC), In some embodiments, the antisense oligonucleotide comprises a combination of 2'-MOE modified nucleosides and one or more (e.g., 1, 2, 3, or 4) scpBNA. In some embodiments, the antisense oligonucleotide comprises a combination of 2'-MOE modified nucleosides and one or more (e.g., 1, 2, 3, or 4) 2'-O-NMA modified nucleosides. In some embodiments, comprises a combination of LNAs and one or more (e.g., 1, 2, 3, or 4) 2'-O-NMA modified nucleosides. In some embodiments, the antisense oligonucleotide comprises a combination of 2'-MOE modified nucleosides, LNAs, and one or more (e.g., 1, 2, 3, or 4) AmNA. In some embodiments, each nucleoside of the antisense oligonucleotide is a 2'-MOE modified nucleoside. In some embodiments, each nucleoside of the antisense oligonucleotide is a 2'-O-NMA modified nucleoside. In some embodiments, the nucleosides at four or more (e.g., 4, 5, 6, 7, 8, 9, 10, 11, 12, or more) positions of the antisense oligonucleotide are nucleosides with the same 2' chemistry

TABLE 16

| Additional exemplary abbreviations | | |
|---|---|---|
| Abbreviation | Name | Structure |
| x | C16 lipid (6-[(1-oxohexadecyl)-amino]hexyl]-phosphoryl) | 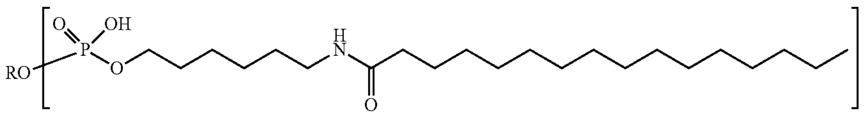 RO is 5' terminal of oligonucleotides |
| n3 | C3 spacer | 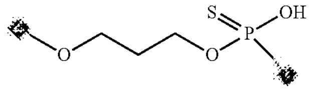 |
| n6 | C6 spacer | 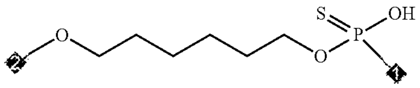 |

In some embodiments, an antisense oligonucleotide disclosed herein comprises one or more modified nucleosides (e.g., one or more 2'-modified nucleosides). In some embodiments, the antisense oligonucleotide comprises a non-bicyclic 2'modified nucleoside, a 2'-4' bridged nucleoside, or combinations thereof (e.g., any combination of 2'-O-methoxyethyl (2'-MOE) modified nucleoside, 2'-O-Methyl (2'-O-Me) modified nucleoside, 2'-fluoro (2'-F) modified nucleosides, LNA, ENA, and cEt). In some embodiments, an antisense oligonucleotide disclosed herein comprises one or more modified nucleosides (e.g., one or more 2'-modified nucleosides). In some embodiments, the antisense oligonucleotide comprises a non-bicyclic 2'-modified nucleoside, a 2'-4' bridged nucleoside, or combinations thereof (e.g., any combination of 2'-MOE modified nucleoside, 2'-O-Me modified nucleoside, 2'-F modified nucleosides, LNA, ENA, cEt, AmNA, BNA (NC), scpBNA, and 2'-O-NMA). In some embodiments, the antisense oligonucleotide comprises a combination of 2'-MOE modified nucleosides and LNAs. In some embodiments, the antisense oligonucleotide comprises a combination of 2'-MOE modified nucleosides and one or more (e.g., 1, 2, 3, or 4) ENA. In some embodiments, the antisense oligonucleotide comprises a combination of 2'-MOE modified nucleosides and one or more (e.g., 1, 2, 3, or 4) AmNA. In some embodiments, the antisense oligonucleotide comprises a combination in the sugar moiety selected from, e.g., 2'-MOE modified nucleoside, 2'-O-Methyl (2'-O-Me) modified nucleoside, 2'-fluoro (2'-F) modified nucleoside, LNA, ENA, and cEt, and the remaining nucleosides are nucleosides with a different 2' chemistry in the sugar moiety, selected from e.g., 2'-MOE modified nucleoside, 2'-O-Methyl (2'-O-Me) modified nucleoside, 2'-fluoro (2'-F) modified nucleoside, LNA, ENA, and cEt. In some embodiments, the nucleosides at four or more (e.g., 4, 5, 6, 7, 8, 9, 10, 11, or 12) positions of the antisense oligonucleotide are LNAs and the remaining nucleosides are nucleosides with different 2' chemistry in the sugar moiety, e.g., 2'-MOE, 2'-O-Methyl (2'-O-Me), 2'-fluoro (2'-F), ENA, or cEt. In some embodiments, the nucleosides at four or more (e.g., 4, 5, 6, 7, 8, 9, 10, 11, or 12) positions of the antisense oligonucleotide are LNAs and all of the remaining nucleosides are 2'-MOE modified nucleosides.

In some embodiments, an antisense oligonucleotide disclosed herein comprises one or more (e.g., 1, 2, or 3) motifs of 2-6 (e.g., 2, 3, 4, 5, or 6) consecutive 2'-4' bridged nucleoside (e.g., LNA, ENA, or cEt). In some embodiments, the remaining nucleosides are non-bicyclic 2'modified nucleoside (e.g., 2'-MOE modified nucleoside, 2'-O-Methyl (2'-O-Me) modified nucleoside, 2'-fluoro (2'-F) modified nucleoside). In some embodiments, at least one of the one or more motifs is located at the 5' end of the antisense oligonucleotide. In some embodiments, at least one of the one or more motifs is located at the 3' end of the antisense oligonucleotide. In some embodiments, at least one of the one or more motifs is located within any of positions 9-16 (counting 5'-3') of the antisense oligonucleotide.

In some embodiments, an antisense oligonucleotide disclosed herein is 20-28 (e.g., 20, 21, 22, 23, 24, 25, 26, 27, or 28) nucleosides in length and comprises one or more (e.g., 1, 2, or 3) motifs of 2-6 (e.g., 2, 3, 4, 5, or 6) consecutive LNAs at the 5' end of the antisense oligonucleotide, the 3' end of the antisense oligonucleotide, and/or within any of positions 9-16 (counting 5'-3') (e.g., 9-10, 9-12, 10-11, 10-12, 10-13, 10-15, 10-16, 11-12, 11-14, 11-16, 12-13, 12-15, and 13-15), and all of the remaining nucleosides are 2'-MOE modified nucleosides.

In some embodiments, an antisense oligonucleotide disclosed herein is 20-28 (e.g., 20, 21, 22, 23, 24, 25, 26, 27, or 28) nucleosides in length, wherein each nucleoside of the antisense oligonucleotide is a 2'-O-NMA modified nucleoside.

In some embodiments, an antisense oligonucleotide disclosed herein is 20-28 (e.g., 20, 21, 22, 23, 24, 25, 26, 27, or 28) nucleosides in length, wherein the nucleosides at one or more (e.g., 1, 2, 3, 4, 5, 6, 7, 8 or more) positions of the antisense oligonucleotide are LNAs and all of the remaining nucleosides are 2'-O-NMA modified nucleosides.

In some embodiments, an antisense oligonucleotide disclosed herein is 20-28 (e.g., 20, 21, 22, 23, 24, 25, 26, 27, or 28) nucleosides in length, wherein each nucleoside of the antisense oligonucleotide is a 2'-MOE modified nucleoside.

In some embodiments, an antisense oligonucleotide disclosed herein is 20-28 (e.g., 20, 21, 22, 23, 24, 25, 26, 27, or 28) nucleosides in length, wherein one or more nucleobases at the 3' end of the first antisense sequence is complementary to one or more nucleobases at the 3' end of the second target region, and/or one or more nucleobases at the 5' end of the second antisense sequence is complementary to one or more nucleobases at the 5' end of the first target region.

In some embodiments, an antisense oligonucleotide disclosed herein is 28 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 28 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 27 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 27 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 26 nucleosides in length, wherein the nucleosides at one or more (e.g., 1, 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 26 nucleosides in length, wherein the nucleosides at four or more (e.g., 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 26 nucleosides in length and comprises one or more (e.g., 1, 2, or 3) motifs of 2-6 (e.g., 2, 3, 4, 5, or 6) consecutive 2'-4' bridged nucleoside (e.g., LNA, ENA, or cEt) within positions 1-6, 10-17, and/or 22-26 (counting 5'-3'). In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 26 nucleosides in length, wherein the nucleosides at positions 11-16 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein the nucleosides at positions 1~4 and 23-26 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein the nucleosides at positions 1-4, 12-15, and 23-26 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein the nucleosides at positions 1-3, 11-16, and 24-26 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein the nucleosides at positions 1~4 and 11-16 (counting 5'=>3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein the nucleosides at positions 11-16 and 23-26 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 26 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, an antisense oligonucleotide disclosed herein is 26 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 26 nucleosides in length, wherein each nucleoside of the antisense oligonucleotide is a 2'-MOE modified nucleoside and the antisense oligonucleotide comprises a mix of ten or more (e.g., 10, 11, 12, 13, 14, 15, 16, 17, 18, 19, 20, 21, 22, 23, 24, 25 or more) phosphorothioate internucleoside linkages and one or more (e.g., 1, 2, 3, 4, 5, 6, 7, 8, 9, 10, 11, 12, 13, 14 or more) phosphodiester internucleoside linkages.

In some embodiments, an antisense oligonucleotide disclosed herein is 26 nucleosides in length, wherein each nucleoside of the antisense oligonucleotide is a 2'-MOE modified nucleoside and the antisense oligonucleotide comprises a mix of ten or more (e.g., 10, 11, 12, 13, 14, 15, 16, 17, 18, 19, 20, or more) phosphorothioate internucleoside linkages and two or more (e.g., 2, 3, 4, 5, 6, 7, 8, 9, 10, 11, 12, 13, 14 or more) phosphodiester internucleoside linkages. In some embodiments, the antisense oligonucleotide comprises two phosphodiester internucleoside linkages and all of the remaining internucleoside linkages are phosphorothioate internucleoside linkages.

In some embodiments, an antisense oligonucleotide disclosed herein is 26 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17, 18, 19, 20, or more) phosphorothioate internucleoside linkages and two or more (e.g., 2, 3, 4, 5, 6, 7, 8, 9, 10, 11, 12, 13, 14 or more) phosphodiester internucleoside linkages. In some embodiments, the antisense oligonucleotide comprises five phosphodiester internucleoside linkages and all of the remaining internucleoside linkages are phosphorothioate internucleoside linkages.

In some embodiments, an antisense oligonucleotide disclosed herein is 26 nucleosides in length, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein is 25 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 25 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 25 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17, 18, 19, 20, or more) phosphorothioate internucleoside linkages and two or more (e.g., 2, 3, 4, 5, 6, 7, 8, 9, 10, 11, 12, 13, 14 or more) phosphodiester internucleoside linkages.

In some embodiments, an antisense oligonucleotide disclosed herein is 25 nucleosides in length, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein is 24 nucleosides in length, wherein the nucleosides at one or more (e.g., 1, 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 24 nucleosides in length, wherein the nucleosides at four or more (e.g., 4, 5, 6, 7, 8, 9, 10, 11, or 12) positions of the antisense oligonucleotide are LNAs and all of the remaining nucleosides are 2'-MOE modified nucleosides. In some embodiments, the antisense oligonucleotide comprises one or more (e.g., 1, 2, or 3) motifs of 2-6 (e.g., 2, 3, 4, 5, or 6) consecutive 2'-4' bridged nucleoside (e.g., LNA, ENA, or cEt) within positions 1-5, 10-16, and/or 20-24. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 24 nucleosides in length, wherein the nucleosides at positions 4, 8, 12, 16, 20, and 24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 10-15 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1-4, 11-14, and 21-24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1-4, 11-14, and 21-24 (counting 5'-3') of the antisense oligonucleotide are LNAs and all of the remaining nucleosides are 2'-MOE modified nucleosides, wherein the antisense oligonucleotide comprises two phosphodiester internucleoside linkages and all of the remaining internucleoside linkages are phosphorothioate internucleoside linkages.

In some embodiments, an antisense oligonucleotide disclosed herein is 24 nucleosides in length, wherein the nucleosides at positions 1, 4, 11-14, 21, and 24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1, 4, 12, 13, 21, and 24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1, 2, 12, 13, 23, and 24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1, 2, 7, 8, 17, 18, 23, and 24 (counting 5'=>3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 13-15 and 22-24 (counting 5'=>3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1-3 and 10-12 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein the nucleosides at positions 1, 6, 12, 13, 19, and 24 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 24 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, an antisense oligonucleotide disclosed herein is 24 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 24 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17, 18, 19, 20, 21 or more) phosphorothioate internucleoside linkages and two or more (e.g., 2, 3, 4, 5, 6, 7, 8, 9, 10, 11, 12, 13 or more) phosphodiester internucleoside linkages.

In some embodiments, an antisense oligonucleotide disclosed herein is 24 nucleosides in length, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein is 22 nucleosides in length, wherein the nucleosides at four or more (e.g., 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 22 nucleosides in length and comprises one or more (e.g., 1, 2, or 3) motifs of 2-6 (e.g., 2, 3, 4, 5, or 6) consecutive 2'-4' bridged nucleoside (e.g., LNA, ENA, or cEt) within positions 1-5, 9-14, and/or 20-22. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 22 nucleosides in length, wherein the nucleosides at positions 1, 2, 10-13, 21, and 22 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 22 nucleosides in length, wherein the nucleosides at positions 1, 2, 10-13, 21, and 22 (counting 5'=>3') of the antisense oligonucleotide are LNAs and all of the remaining nucleosides are 2'-MOE modified nucleosides, and the antisense oligonucleotide comprises a mix of ten or more (e.g., 10, 11, 12, 13, 14, 15, 16, 17, 18, 19, 20, or more) phosphorothioate internucleoside linkages and five or more (e.g., 5, 6, 7, 8, 9, 10, 11, 12, 13, 14 or more) phosphodiester internucleoside linkages.

In some embodiments, an antisense oligonucleotide disclosed herein is 22 nucleosides in length, wherein the nucleosides at positions 1, 2, 10-13, 21, and 22 (counting 5'→3') of the antisense oligonucleotide are LNAs and all of the remaining nucleosides are 2'-MOE modified nucleosides, and the antisense oligonucleotide comprises a mix of ten or more (e.g., 10, 11, 12, 13, 14, 15, 16, 17, 18, 19, 20, or more) phosphorothioate internucleoside linkages and twelve or less (e.g., 1, 2, 3, 4, 5, 6, 7, 8, 9, 10, 11, 12) phosphodiester internucleoside linkages.

In some embodiments, an antisense oligonucleotide disclosed herein is 22 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, an antisense oligonucleotide disclosed herein is 22 nucleosides in length, wherein each nucleoside of the antisense oligonucleotide is a 2'-MOE modified nucleoside and each internucleoside linkage of the antisense oligonucleotide is a phosphorothioate linkage.

In some embodiments, an antisense oligonucleotide disclosed herein is 22 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17, 18, 19 or more) phosphorothioate internucleoside linkages and two or more (e.g., 2, 3, 4, 5, 6, 7, 8, 9, 10, 11 or more) phosphodiester internucleoside linkages.

In some embodiments, an antisense oligonucleotide disclosed herein is 22 nucleosides in length, wherein each nucleoside of the antisense oligonucleotide is a 2'-O-NMA modified nucleoside and each internucleoside linkage of the antisense oligonucleotide is a phosphorothioate internucleoside linkage. In some embodiments, an antisense oligonucleotide disclosed herein is 19 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 20 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 20 nucleosides in length, wherein the nucleosides at four or more (e.g., 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 21 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 22 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 23 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 24 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 24 nucleosides in length, wherein the nucleosides at four or more (e.g., 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 25 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 26 nucleosides in length, wherein the nucleosides at two or more (e.g., 2, 3, 4, 5, 6, 7, 8, 9, 10, 11, or 12) positions of the antisense oligonucleotide are LNAs and all of the remaining nucleosides are 2'-MOE modified nucleosides. In some embodiments, an antisense oligonucleotide disclosed herein is 20 nucleosides in length and comprises one or more (e.g., 1, 2, or 3) motifs of 2-6 (e.g., 2, 3, 4, 5, or 6) consecutive 2'-4' bridged nucleoside (e.g., LNA, ENA, or cEt) within positions 1-5, 9-13, and/or 16-20. In some embodiments, the antisense oligonucleotide comprises one or more (e.g., 1, 2, 3, 4, 5, 6, 7, 8, 9, 10, or more) phosphorothioate internucleoside linkages. In some embodiments, the antisense oligonucleotide comprises a mix of one or more (e.g., 1, 2, 3, 4, 5, 6, 7, 8, 9, 10, or more) phosphorothioate internucleoside linkages and one or more (e.g., 1, 2, 3, 4, 5, 6, 7, 8, 9, 10, or more) phosphodiester internucleoside linkages.

In some embodiments, an antisense oligonucleotide disclosed herein is 20 nucleosides in length, wherein the nucleosides at positions 1, 2, 19, and 20 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 21 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17, 18, or more) phosphorothioate internucleoside linkages and two or more (e.g., 2, 3, 4, 5, 6, 7, 8, 9, 10 or more) phosphodiester internucleoside linkages.

In some embodiments, an antisense oligonucleotide disclosed herein is 21 nucleosides in length, wherein the nucleosides at positions 1 and 21 (counting 5'-3') of the antisense oligonucleotide are LNAs and all of the remaining nucleosides are 2'-O-NMA modified nucleosides, wherein each internucleoside linkage of the antisense oligonucleotide is a phosphorothioate internucleoside linkage.

In some embodiments, an antisense oligonucleotide disclosed herein is 21 nucleosides in length, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein is 20 nucleosides in length, wherein the nucleosides at positions 1, 2, 19, and 20 (counting 5'-3') of the antisense oligonucleotide are LNAs and all of the remaining nucleosides are 2'-MOE modified nucleosides, wherein the antisense oligonucleotide comprises two phosphodiester internucleoside linkages and all of the remaining internucleoside linkages are phosphorothioate internucleoside linkages.

In some embodiments, an antisense oligonucleotide disclosed herein is 20 nucleosides in length, wherein the nucleosides at positions 1, 2, 9, and 10 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein the nucleosides at positions 9-12 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein the nucleosides at positions 11, 12, 19, and 20 (counting 5'=>3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein the nucleosides at positions 1, 2, 10, 11, 19, and 20 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein the nucleosides at positions 1, 2, 4, and 5 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein the nucleosides at positions 16, 17, 19, and 20 (counting 5'-3') of the antisense oligonucleotide are LNAs and all of the remaining nucleosides are 2'-MOE modified nucleosides, wherein each internucleoside linkage of the antisense oligonucleotide is a phosphorothioate linkage.

In some embodiments, an antisense oligonucleotide disclosed herein is 20 nucleosides in length, wherein each nucleoside of the antisense oligonucleotide is a 2'-O-NMA modified nucleoside and the antisense oligonucleotide comprises a mix of ten or more (e.g., 10, 11, 12, 13, 14, 15, 16, 17 or more) phosphorothioate internucleoside linkages and two or more (e.g., 2, 3, 4, 5, 6, 7, 8, 9 or more) phosphodiester internucleoside linkages.

In some embodiments, an antisense oligonucleotide disclosed herein is 20 nucleosides in length, wherein the nucleosides at positions 1 and 20 (counting 5'-3') of the antisense oligonucleotide are LNAs and all of the remaining nucleosides are 2'-O-NMA modified nucleosides, wherein each internucleoside linkage of the antisense oligonucleotide is a phosphorothioate internucleoside linkage.

In some embodiments, an antisense oligonucleotide disclosed herein is 20 nucleosides in length, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein is 20 nucleosides in length, wherein each nucleoside of the antisense oligonucleotide is a 2'-MOE modified nucleoside. In some embodiments, the antisense oligonucleotide comprises one or more (e.g., 1, 2, 3, 4, 5, 6, 7, 8, 9, 10, or more) phosphorothioate internucleoside linkages. In some embodiments, an antisense oligonucleotide disclosed herein is 20 nucleosides in length, wherein each nucleoside of the antisense oligonucleotide is a 2'-MOE modified nucleoside and each internucleoside linkage of the antisense oligonucleotide is a phosphorothioate linkage. In some embodiments, an antisense oligonucleotide disclosed herein is 20 nucleosides in length, wherein each nucleoside of the antisense oligonucleotide is a 2'-MOE modified nucleoside and each internucleoside linkage of the antisense oligonucleotide is a phosphorothioate linkage, wherein one or more nucleobases at the 3' end of the first antisense sequence is complementary to one or more nucleobases at the 3' end of the second target region, and/or one or more nucleobases at the 5' end of the second antisense sequence is complementary to one or more nucleobases at the 5' end of the first target region.

In some embodiments, an antisense oligonucleotide disclosed herein comprises any one of the nucleobase sequences described herein (e.g., listed in Table 3 and Table 9) and further comprises modified nucleosides selected from one of the following patterns (5'→3'):

```
MMMMMMMMMMMMMMMMMMMMMMMMMMMM,
MMMMMMMMMMMMMMMMMMMMMMMMMMM,
MMMMMMMMMMMMMMMMMMMMMMMMMM,
MMMMMMMMMMMMMMMMMMMMMMMMM,
MMMMMMMMMMMMMMMMMMMMMMMM,
MMMMMMMMMMMMMMMMMMMMMM,
MMMMMMMMMMMMMMMMMMMM,
MMMMMMMMMMLLLLLLMMMMMMMMMM,
MMMMMMMMMLLLLLLMMMMMMMMM,
MMMMMMMMMMLLLLLLMMMMMMLLLL,
LLLLMMMMMMLLLLLLMMMMMMMMMM,
LLLLMMMMMMLLLLMMMMMMLLLL,
LLLMMMMMMMLLLLLLMMMMMMMLLL,
LLLLMMMMMMMLLLLMMMMMMMLLLL,
LLLLMMMMMMMMMMMMMMMMMMLLLL,
MMMLMMMLMMMLMMMLMMMLMMML,
LMMLMMMMMMLLLLMMMMMMLMML,
LMMLMMMMMMMLLMMMMMMMLMML,
LLMMMMMMMMMLLMMMMMMMMMLL,
LLMMMMLLMMMMMMMMLLMMMMLL,
MMMMMMMMMMMMLLLMMMMMMLLL,
LLLMMMMMMLLLMMMMMMMMMMMM,
LMMMMLMMMMMLLMMMMMLMMMML,
LLMMMMMMMLLLLMMMMMMMLL,
LLMMMMMMMMMMMMMMMMLL,
LLMMMMMMLLMMMMMMMMMM,
MMMMMMMMLLLLMMMMMMMM,
MMMMMMMMMMLLMMMMMMLL,
LLMMMMMMMLLMMMMMMMLL,
LLMLLMMMMMMMMMMMMMMM,
and
MMMMMMMMMMMMMMMLLMLL,

wherein M is a 2'-O-methoxyethyl (2'-MOE)

modified nucleoside and L is an LNA.
```

wherein M is a 2'-O-methoxyethyl (2'-MOE) modified nucleoside and L is an LNA.

In some embodiments, an antisense oligonucleotide disclosed herein comprises any one of the nucleobase sequences described herein (e.g., listed in Table 3 and Table 9) and further comprises modified nucleosides selected from one of the following patterns (5'→3'):

MLLMMMMMMMMMMMMMMMMMMMMMLL,

MMLLMMMMMMLLMMMMMMMMMMMMMM,

MMMMMLLMMMMMMMMMMMMMMMMMMM,

MMMMMLLMMMMMMMMMMMMLLMMMMM,

MMMMMMMMMMMLLLMMMMMMMMMMMM,

MLLMMMMMMMMMMMMMMMMMMMMMMM,

LLMMMMMMMMMMLLMMMMMMMMLL,

LLMMMMMMMMLLLLMMMMMMLLLL,

LLLLMMMMMMLLLLMMMMMMMMLL,

LLLLMMMMMMMLLMMMMMMMLLLL,

LLLMMMMMMMLLLLMMMMMMMLLL,

LLLMMMMMMMMLLMMMMMMMMLLL,

LLMLLMMMMMLLLLMMMMMMLLLL,

LLMMMMMMMMMMMMMMMMMMMMMMMM,

MMLLMMMMMMMMMMMMMMMMMMMMMM,

MMMMLLMMMMMMMMMMMMMMMMMMMM,

MMMMMMLLMMMMMMMMMMMMMMMMMM,

MMMMMMMMLLMMMMMMMMMMMMMMMM,

MMMMMMMMMMLLMMMMMMMMMMMMMM,

MMMMMMMMMMMMLLMMMMMMMMMMMM,

MMMMMMMMMMMMMMLLMMMMMMMMMM,

MMMMMMMMMMMMMMMMLLMMMMMMMM,

MMMMMMMMMMMMMMMMMMLLMMMMMM,

MMMMMMMMMMMMMMMMMMMMLLMMMM,

MMMMMMMMMMMMMMMMMMMMMMLLMM,

MMMMMMMMMMMMMMMMMMMMMMMMLL,

MMLLMMMMMMMMMMMMMMMMMMLLMM,

MMMMLLMMMMMMMMMMMMMMLLMMMM,

MMMMMMMMLLMMMMMMLLMMMMMMMM,

LMMMMMMMMMMMMMMMMMML,

LLMMMMMMMMMMMMMMMMMMMMMMLL,

MMMMMMMMLLMMMMMMMMMMM,

LLMMMLLMMMMMMMMMMMLL,

LLMMMMMLLMMMMMMMMMLL,

LLMMMMLLMMMMMMMMMMLL,

LLMMMMMMMMMLLMMMMMLL,

LMMMMMMMMMMMMMMMMMMML,

LMMMMMLLMMMMMMMMMMMML,

LLMMMMMMMMMMMMMMMLL,

LMMMMMMLLMMMMMMMMMML,

LMMMMMLMMLMMMMMMMMML,

-continued

MMLMMMLMMMMMMLMMMLMM,

LMMMMMLMMMMMMLMMMMML,

MMLLMMMMMMMMMMMMLLMM,

MMMMMMLLMMMMLLMMMMMM,

LLMMMMMMMMMMMMMMMMMM,

MMLLMMMMMMMMMMMMMMMM,

MMMMLLMMMMMMMMMMMMMM,

MMMMMMLLMMMMMMMMMMMM,

MMMMMMMMLLMMMMMMMMMM,

MMMMMMMMMMLLMMMMMMMM,

MMMMMMMMMMMMLLMMMMMM,

MMMMMMMMMMMMMMLLMMMM,

MMMMMMMMMMMMMMMMLLMM,

MMMMMMMMMMMMMMMMMMLL,

LLMMMMMMMMMMMMMMMMMMM,

MMLLMMMMMMMMMMMMMMMMM,

MMMMLLMMMMMMMMMMMMMMM,

MMMMMMLLMMMMMMMMMMMMM,

MMMMMMMMMMLLMMMMMMMMM,

MMMMMMMMMMMMLLMMMMMMM,

MMMMMMMMMMMMMMLLMMMMM,

MMMMMMMMMMMMMMMMLLMMM,

MMMMMMMMMMMMMMMMMMLLM,

MMMMMMMMMMMMMMMMMMMLL,

MLMMMMMMMMMMMMMMMMMLM,

MMMLMMMMMMMMMMMMMLMMM,

MMMMMLMMMMMMMMMLMMMMM,

MMMMMMMLMMMMMLMMMMMMM,

MLMMMMMMMMMMMMMMMMLM,

MMMLMMMMMMMMMMMMLMMM,

MMMMMLMMMMMMMMLMMMMM,

MMMMMMMLMMMMLMMMMMMM,

LMMMMMMMMMMMMMMMMMMLM,

MLMMMMMMMMMMMMMMMMMML,

LMMMMMMMMMMMMMMMMMMM,

MMMMMMMMMMMMMMMMMMML,

LMMMMMMMMMMMMMMMMMMMM,

MMMMMMMMMMMMMMMMMMMML,

LMMMMMMMMMMMMMMMMMMMML,

LMMMMMMMMMMMMMMMMMMMMML,

-continued

LMMMMMMMMMMMMMMMMMMMMMML,

LMMMMMLMMMMMMMMMMMMM,

MMMMMMLMMMMMMMMMMMML,

MMMMMMMLLMMMMMMMMMMM,

LMMMMMMLMMMMMMMMMMMM,

MMMMMMMLMMMMMMMMMMML,

LMMMMMMMLMMMMMMMMMMM,

LMMMMMMMMLMMMMMMMMMM,

MMMMMMMMMLMMMMMMMMML,

MMMMMMMMLMMMMMMMMMML,

LMMMMMLMMMMMMMMMMMMMM,

MMMMMMLMMMMMMMMMMMMML,

MMMMMMMLLMMMMMMMMMMMM,

LMMMMMMLMMMMMMMMMMMMM,

MMMMMMMLMMMMMMMMMMMML,

LMMMMMMMLMMMMMMMMMMMM,

MMMMMMMMMLMMMMMMMMMML,

MMMMMMMMLMMMMMMMMMMML,

LMMMMMMMMLMMMMMMMMMMM,

LMMMMMMMMMLMMMMMMMMMM,

MMMMMMMMMMLMMMMMMMMML,

L-nma-nma-nma-nma-nma-nma-nma-nma-
nma-nma-nma-nma-nma-nma-nma-nma-
nma-nma-L,

L-nma-nma-nma-nma-nma-nma-nma-nma-
nma-nma-nma-nma-nma-nma-nma-nma-
nma-nma-nma-L, nma-nma-nma-nma-nma-nma-nma-nma-nma-
nma-nma-nma-nma-nma-nma-nma-nma-
nma-nma-nma-nma-nma-nma-nma-nma-nma, xdddMMMMMMMMMMMMMMMMMMMMMMMMMM, zzMMMMMMMzzzzMMMMMMMzL, zzzzMMMMMMzzzzMMMMMMzzzL, enaMMMMMMMMMMMMMMMMMMena, bMMMMMMMMMMMMMMMMMMb, enaMMMMMMMMMMMMMMMMMMMena, scpMMMMMMMMMMMMMMMMMMMscp, bMMMMMMMMMMMMMMMMMMMb,

LMMMMMMMMMMMMMMMMMLM,

MzMMMMMMMMMMMMMMMMzM, enaMMMMMMMMMMMMMMMMMenaM,

MenaMMMMMMMMMMMMMMMMenaM,

MenaMMMMMMMMMMMMMMMMMena,

MzMMMMMMMMMMMMMMMMMzM,

MscpMMMMMMMMMMMMMMMMMMscp, enaMMMMMMMMMMMMMMMMMMenaM,

MenaMMMMMMMMMMMMMMMMMenaM,

MenaMMMMMMMMMMMMMMMMMMena, xdddLMMMMMMMMMMMMMMMMMML, xdddLMMMMMMMMMMMMMMMMMMML,

MMMMMMMMMMMMM[n]MMMMMMMMMMMMM,

LMMMMMM[n]MMMMMMMMMMMML,

LMMMMMM[n]MMMMMMMMMMMMML,

LMMMMMMMM[n]MMMMMMMMMML,

LMMMMMMMM[n]MMMMMMMMMMML,

LMMMMMMM[n]MMMMMMMMMMML, and

LMMMMMMM[n]MMMMMMMMMMMML, wherein M is a 2'-O-methoxyethyl (2'-MOE) modified nucleoside, L is an LNA, x is a C16 lipid, 6-[(1-oxohexadecyl)amino]hexyl] phosphoryl, [n] is a C3 or C6 spacer (e.g., a C3 or C6 spacer as shown in Table 16), dis DNA, ena is ENA, b is BNA(NC), z is AmNA, nma is 2'O-NMA modified nucleoside, and scp is scpBNA.

In some embodiments, an antisense oligonucleotide disclosed herein comprises modified internucleoside linkages comprising one of the following patterns (5'→3'):

S-S-S-S-S-S-S-S-S-S-S-S-S-S-S-S-S-S-S-S-S-S-S-
S-S-S-S,

S-S-S-S-S-S-S-S-S-S-S-S-S-S-S-S-S-S-S-S-S-S-S-S-
S-S,

S-S-S-S-S-S-S-S-S-S-S-S-S-S-S-S-S-S-S-S-S-S-S-S-S,

S-S-S-S-S-S-S-S-S-S-S-S-S-S-S-S-S-S-S-S-S-S-S-S,

S-S-S-S-S-S-S-S-S-S-S-S-S-S-S-S-S-S-S-S-S-S-S,

S-S-S-S-S-S-S-S-S-S-S-S-S-S-S-S-S-S-S-S-S,

S-S-S-S-S-S-S-S-S-S-S-S-S-S-S-S-S-S-S,

S-O-O-O-O-O-S-S-S-S-S-S-S-S-S-S-S-S-S-O-O-O-O-O-S,

S-O-O-O-O-O-S-S-S-S-S-O-O-O-S-S-S-S-S-O-O-O-O-O-S,

S-S-S-S-S-S-S-S-S-O-O-O-O-O-O-O-S-S-S-S-S-S-S-S-S,

S-S-S-S-S-S-S-S-S-S-S-S-S-S-S-S-S-S-S-O-O-O-O-O-S,

S-O-O-O-O-O-S-S-S-S-S-S-S-S-S-S-S-S-S-S-S-S-S-S,

S-O-O-O-O-S-S-S-S-S-S-S-S-S-S-S-S-S-S-S-O-O-O-O-S,

S-O-O-O-S-S-S-S-S-S-S-S-S-S-S-S-S-S-S-S-S-O-O-O-S,

S-O-S-O-S-O-S-O-S-O-S-O-S-O-S-O-S-O-S-O-S-O-S-O-S,

-continued

S-O-O-S-S-S-S-S-S-S-S-S-S-S-S-S-S-S-S-S-S-S-S-S-S,

S-S-S-S-S-S-S-S-S-S-O-O-S-S-S-S-S-S-S-S-S-S-S-S-S,

S-S-S-S-S-S-S-S-S-S-S-S-S-S-O-O-S-S-S-S-S-S-S-S-S,

S-S-S-S-S-S-S-S-S-S-S-S-S-S-S-S-S-S-S-S-S-S-O-O-S,

S-S-S-S-S-S-S-S-S-S-S-S-S-S-S-S-S-S-S-S-S-O-O-O-S,

S-S-S-S-S-S-S-S-S-S-S-S-S-S-S-S-S-S-S-S-O-O-O-O-S,

S-O-O-S-S-S-S-S-S-S-S-S-S-S-S-S-S-S-S-S-S-S-S,

S-S-S-S-S-S-S-S-S-O-O-S-S-S-S-S-S-S-S-S-S-S-S,

S-S-S-S-S-S-S-S-S-S-S-S-S-O-O-S-S-S-S-S-S-S-S,

S-S-S-S-S-S-S-S-S-S-S-S-S-S-S-S-S-S-S-S-O-O-S,

S-O-O-O-O-S-S-S-S-S-S-S-S-S-S-S-O-O-O-O-S,

S-S-S-S-S-S-S-S-S-S-S-S-S-S-S-O-O-O-O-O-S,

S-S-S-S-S-S-S-S-S-S-O-O-S-S-S-S-S-O-O-O-S,

S-O-O-S-S-S-S-S-S-O-O-O-O-S-S-S-S-S-O-O-S,

S-O-O-S-S-S-S-S-S-S-S-S-S-S-S-S-S-S-S,

S-S-S-S-S-S-S-O-O-S-S-S-S-S-S-S-S-S-S,

S-S-S-S-S-S-S-S-S-S-S-O-O-S-S-S-S-S-S, and

S-S-S-S-S-S-S-S-S-S-S-S-S-S-S-S-O-O-S, wherein s is a phosphorothioate internucleoside linkage and o is a phosphodiester internucleoside linkage.

In some embodiments, an antisense oligonucleotide disclosed herein comprises modified internucleoside linkages comprising one of the following patterns (5'→3'):

S-S-S-S-S-S-S-S-S-S-S-S-S-O-O-O-S-S-S-O-O-O-O-O-S,

S-S-S-S-S-S-S-S-S-S-O-O-S-S-O-O-S-S-S-S-S-S-S-S-S,

S-O-O-S-S-S-S-S-S-S-S-S-S-S-S-S-S-S-S-S-S-S-O-O-S,

S-O-O-O-S-S-S-S-S-S-S-S-S-S-S-S-S-S-S-S-S-S-S-S-S,

S-S-S-O-O-O-S-S-S-S-S-S-S-S-S-S-S-S-S-S-S-S-S-S-S,

S-S-S-S-S-O-O-O-S-S-S-S-S-S-S-S-S-S-S-S-S-S-S-S-S,

S-S-S-S-S-S-S-O-O-O-S-S-S-S-S-S-S-S-S-S-S-S-S-S-S,

S-S-S-S-S-S-S-S-S-O-O-O-S-S-S-S-S-S-S-S-S-S-S-S-S,

S-S-S-S-S-S-S-S-S-S-S-O-O-O-S-S-S-S-S-S-S-S-S-S-S,

S-S-S-S-S-S-S-S-S-S-S-S-S-O-O-O-S-S-S-S-S-S-S-S-S,

S-S-S-S-S-S-S-S-S-S-S-S-S-S-S-O-O-O-S-S-S-S-S-S-S,

S-S-S-S-S-S-S-S-S-S-S-S-S-S-S-S-S-O-O-O-S-S-S-S-S,

S-S-S-S-S-S-S-S-S-S-S-S-S-S-S-S-S-S-S-O-O-O-S-S-S,

S-S-S-S-S-S-S-S-S-S-S-S-S-S-S-S-S-S-S-S-O-O-O-O-O-S,

S-S-S-S-S-S-S-S-O-O-S-S-S-S-S-S-S-S-S-S-S-S-S,

S-S-S-S-S-S-S-S-S-S-O-O-S-S-S-S-S-S-S-S-S-S-S,

S-S-S-S-S-S-S-S-O-O-O-S-S-S-S-S-S-S-S-S-S-S-S,

S-S-S-S-S-S-S-S-S-O-O-O-S-S-S-S-S-S-S-S-S-S-S,

S-O-O-O-S-S-S-S-S-S-O-O-O-S-S-S-S-S-S-S-S-S-S-S-S,

S-O-O-O-S-S-S-S-S-S-S-S-S-S-O-O-O-S-S-S-S-S-S-S-S,

S-O-O-S-S-S-S-S-S-S-O-O-S-S-S-S-S-S-S-S-S-S-S-S-S,

S-O-O-S-S-S-S-S-S-S-S-S-S-S-O-O-S-S-S-S-S-S-S-S-S,

S-S-S-S-S-S-S-S-S-S-S-S-S-S-S-S-S-S-S-O-S-S-S-S-S,

S-S-S-S-S-S-S-S-S-S-S-S-S-S-S-S-S-S-S-S-O-S-S-S-S,

S-S-S-S-S-S-S-S-S-S-S-S-S-S-S-S-S-O-O-O-O-O-S,

S-S-S-S-S-S-S-S-S-S-S-S-S-S-S-O-O-O-S,

S-S-S-S-S-S-O-O-S-S-S-S-S-S-S-S-S-S-S,

S-O-O-S-S-S-S-S-S-S-S-S-S-S-S-S-S-S-S,

-continued

S-O-O-S-S-S-O-O-S-S-S-S-S-S-S-S-S-S-S,

S-S-S-S-S-S-O-O-S-S-S-S-S-S-S-S-O-O-S,

S-S-S-S-S-S-S-S-S-S-S-S-S-S-S-S-S-S,

S-O-O-O-S-S-S-S-S-S-S-S-S-S-S-S-S-S-S,

S-O-O-O-S-S-S-S-S-S-S-S-S-S-S-O-O-O-S,

S-O-O-S-S-S-S-S-S-S-S-S-S-S-S-O-O-S,

S-S-S-O-O-S-S-S-S-S-S-S-S-S-S-S-S-S-S,

S-S-S-S-S-O-O-S-S-S-S-S-S-S-S-S-S-S-S,

S-S-S-S-S-S-S-O-O-S-S-S-S-S-S-S-S-S-S,

S-S-S-S-S-S-S-S-S-O-O-S-S-S-S-S-S-S-S,

S-S-S-S-S-S-S-S-S-S-S-S-S-O-O-S-S-S-S,

S-S-S-S-S-S-S-S-S-S-S-S-S-S-S-O-O-S-S,

S-O-O-S-S-S-S-S-S-S-S-S-S-S-S-S-S-S-S-S,

S-S-S-O-O-S-S-S-S-S-S-S-S-S-S-S-S-S-S-S,

S-S-S-S-S-O-O-S-S-S-S-S-S-S-S-S-S-S-S-S,

S-S-S-S-S-S-S-O-O-S-S-S-S-S-S-S-S-S-S-S,

S-S-S-S-S-S-S-S-S-S-S-S-S-S-S-O-O-S-S,

S-O-O-S-S-S-S-S-S-S-S-S-S-S-S-S-S-S-S-S,

S-S-S-O-O-S-S-S-S-S-S-S-S-S-S-S-S-S-S-S,

S-S-S-S-S-O-O-S-S-S-S-S-S-S-S-S-S-S-S-S,

S-S-S-S-S-S-S-O-O-S-S-S-S-S-S-S-S-S-S-S,

S-S-S-S-S-S-S-S-S-O-O-S-S-S-S-S-S-S-S-S,

S-S-S-S-S-S-S-S-S-S-S-O-O-S-S-S-S-S-S-S,

S-S-S-S-S-S-S-S-S-S-S-S-S-O-O-S-S-S-S-S,

S-S-S-S-S-S-S-S-S-S-S-S-S-S-S-O-O-S-S-S,

S-S-S-S-S-S-S-S-S-S-S-S-S-S-S-S-S-O-S-S,

S-S-S-S-S-S-S-S-S-S-S-S-S-S-S-S-S-S-S-S-S-S,

O-O-O-S-S-S-S-S-S-S-S-S-S-S-S-S-S-S-S-S-S-S,

O-O-O-S-S-S-S-S-S-S-S-S-S-S-S-S-S-S-S-S-S-S-O-O-O-O-O-S,

S-S-S-S-S-S-S-S-S-S-S-S-S-S-S-S-S-S-S-O-O-O-O-O-S,

O-O-O-S-S-S-S-S-S-S-S-S-S-S-S-S-S-S-S-S-S-S-S,

O-O-O-S-S-S-S-S-S-S-S-S-S-S-S-S-S-S-S-S-S-S-S-S-O-O-O-S,

S-S-S-S-S-S-S-S-S-S-S-S-S-S-S-S-S-S-S-S-S-S-O,
and

S-S-S-S-S-S-S-S-S-S-S-S-S-S-S-S-S-S-S-S,
wherein s is a phosphorothioate internucleoside linkage and o is a phosphodiester internucleoside linkage.

In some embodiments, an antisense oligonucleotide disclosed herein comprises a nucleobase sequence of SEQ ID NO: 1 and comprises chemical modifications, wherein each nucleoside of the antisense oligonucleotide is a 2'-MOE modified nucleoside and each internucleoside linkage of the antisense oligonucleotide is a phosphorothioate internucleoside linkage.

In some embodiments, an antisense oligonucleotide disclosed herein comprises a nucleobase sequence of SEQ ID NO: 2 and comprises chemical modifications, wherein each nucleoside of the antisense oligonucleotide is a 2'-MOE modified nucleoside and each internucleoside linkage of the antisense oligonucleotide is a phosphorothioate internucleoside linkage.

In some embodiments, an antisense oligonucleotide disclosed herein comprises a nucleobase sequence of SEQ ID NO: 2 and comprises chemical modifications, wherein each nucleoside of the antisense oligonucleotide is a 2'-MOE modified nucleoside and the antisense oligonucleotide comprises a mix of ten or more (e.g., 10, 11, 12, 13, 14, 15, 16, 17, 18, 19, 20, 21, 22, 23 or more) phosphorothioate internucleoside linkages and one or more (e.g., 1, 2, 3, 4, 5, 6, 7, 8, 9, 10, 11, 12, 13, 14 or more) phosphodiester internucleoside linkages.

In some embodiments, an antisense oligonucleotide disclosed herein comprises a nucleobase sequence of SEQ ID NO: 16 and comprises chemical modifications, wherein each nucleoside of the antisense oligonucleotide is a 2'-MOE modified nucleoside and each internucleoside linkage of the antisense oligonucleotide is a phosphorothioate internucleoside linkage.

In some embodiments, an antisense oligonucleotide disclosed herein comprises a nucleobase sequence of SEQ ID NO: 17 and comprises chemical modifications, wherein each nucleoside of the antisense oligonucleotide is a 2'-MOE modified nucleoside and each internucleoside linkage of the antisense oligonucleotide is a phosphorothioate internucleoside linkage.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises a mix of ten or more (e.g., 10, 11, 12, 13, 14, 15, 16, 17, 18, 19, 20, 21, 22, 23 or more) phosphorothioate internucleoside linkages and one or more (e.g., 1, 2, 3, 4, 5, 6, 7, 8, 9, 10, 11, 12, 13, 14 or more) phosphodiester internucleoside linkages.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises a mix of 22 phosphorothioate internucleoside linkages and 3 phosphodiester internucleoside linkages.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises a mix of 21 phosphorothioate internucleoside linkages and 4 phosphodiester internucleoside linkages.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises a mix of 19 phosphorothioate internucleoside linkages and 6 phosphodiester internucleoside linkages.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises modified internucleoside linkages comprising the following pattern (5'→3'): s-s-s-s-s-s-s-s-s-s-s-s-s-s-s-s-s-s-s-s-o-o-o-o-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises modified internucleoside linkages comprising the following pattern (5'→3'): s-s-s-s-s-s-s-s-s-s-s-s-s-s-s-s-s-s-s-s-o-o-o-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises modified internucleoside linkages comprising the following pattern (5'→3'): s-o-o-s-s-s-s-s-s-s-s-s-s-s-o-o-s-s-s-s-s-s-s-s-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises modified internucleoside linkages comprising the following pattern (5'→3'): s-o-o-s-s-s-s-s-s-s-s-s-s-s-s-s-s-s-s-s-s-s-o-o-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-MOE modified nucleoside and the antisense oligonucleotide comprises modified internucleoside linkages comprising the following pattern (5'→3'): s-o-o-o-s-s-s-s-s-s-s-s-s-s-s-s-s-s-s-s-s-o-o-o-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-O-NMA modified nucleoside and the antisense oligonucleotide comprises modified internucleoside linkages comprising the following pattern (5'→3'): s-s-s-s-s-s-s-s-s-s-s-s-s-s-s-s-s-s-s-s-o-o-o-o-o-s.

In some embodiments, an antisense oligonucleotide disclosed herein comprises a nucleobase sequence of SEQ ID NO: 9 and comprises chemical modifications, wherein each nucleoside of the antisense oligonucleotide is a 2'-O-NMA modified nucleoside and each internucleoside linkage of the antisense oligonucleotide is a phosphorothioate internucleoside linkage.

In some embodiments, an antisense oligonucleotide disclosed herein comprises a nucleobase sequence of SEQ ID NO: 2 and comprises chemical modifications, wherein each nucleoside of the antisense oligonucleotide is a 2'-O-NMA modified nucleoside and each internucleoside linkage of the antisense oligonucleotide is a phosphorothioate linkage.

In some embodiments, an antisense oligonucleotide disclosed herein comprises a nucleobase sequence of SEQ ID NO: 93 and comprises chemical modifications, wherein each nucleoside of the antisense oligonucleotide is a 2'-O-NMA modified nucleoside and each internucleoside linkage of the antisense oligonucleotide is a phosphorothioate linkage.

In some embodiments, an antisense oligonucleotide disclosed herein comprises a nucleobase sequence of SEQ ID NO: 455 and comprises chemical modifications, wherein the nucleosides at positions 1 and 20 (counting 5'-3') of the antisense oligonucleotide are LNAs and all of the remaining nucleosides are 2'-O-NMA modified nucleosides and each internucleoside linkage of the antisense oligonucleotide is a phosphorothioate linkage.

In some embodiments, an antisense oligonucleotide disclosed herein comprises a nucleobase sequence of SEQ ID NO: 461 and comprises chemical modifications, wherein the nucleosides at positions 1 and 21 (counting 5'-3') of the antisense oligonucleotide are LNAs and all of the remaining nucleosides are 2'-O-NMA modified nucleosides and each internucleoside linkage of the antisense oligonucleotide is a phosphorothioate linkage.

In some embodiments, any one of the antisense oligonucleotides disclosed herein, can be linked to a lipid (e.g., a C16 lipid). In some embodiments, the lipid (e.g., a C16 lipid) targets muscle. In some embodiments, the lipid (e.g., a C16 lipid) is linked to the 5' nucleoside of the antisense oligonucleotide via a DNA linker. In some embodiments, the DNA linker is a phosphodiester d (TCA) linker, wherein each internucleoside linkage is a phosphodiester linkage.

In some embodiments, an antisense oligonucleotide comprises a first antisense sequence and a second antisense sequence, and comprises chemical modifications (e.g., one or more modified nucleosides and/or one or more modified internucleoside linkages). In some embodiments the antisense oligonucleotide comprises a structure provided in Table 5.

In some embodiments, an antisense oligonucleotide comprises a first antisense sequence and a second antisense sequence, and comprises chemical modifications (e.g., one or more modified nucleosides and/or one or more modified internucleoside linkages). In some embodiments the antisense oligonucleotide comprises a structure provided in Table 11.

TABLE 5

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 1 | CACGAATCTACCCCCATCCATGTACT | 1 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iT] | 574 |
| 2 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] | 571 |
| 3 | CACGAATCTACCCCATCCATGTACTC | 3 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iTs][i$^5$C] | 575 |
| 4 | CGAATCTACCCACGAGTTCTTTCCAG | 4 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iAs][iGs][iTs][iTs][i$^5$Cs][iTs][iTs][iTs][i$^5$Cs][i$^5$Cs][iAs][iG] | 576 |
| 5 | CGAATCTACCCACTAAGAGTTCTTTC | 5 | [i$^5$Cs][iGs][iAs][iAs][iTs][i$^5$Cs][iTs][iAs][i$^5$Cs][i$^5$Cs][i$^5$Cs][iAs][i$^5$Cs][iTs][iAs][iAs][iGs][iAs][iGs][iTs][iTs][i$^5$Cs][iTs][iTs][iTs][i$^5$C] | 577 |
| 6 | CCACGAATCTACCGATAAGAGTTCTT | 6 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iAs][iTs][iAs][iAs][iGs][iAs][iGs][iTs][iTs][i$^5$Cs][iTs][iT] | 578 |
| 7 | CACGAATCTACCCGGATAAGAGTTCT | 7 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iGs][iAs][iTs][iAs][iAs][iGs][iAs][iGs][iTs][iTs][i$^5$Cs][iT] | 579 |
| 8 | CCACGAATCTACCGGATAAGAGTTCT | 8 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iGs][iAs][iTs][iAs][iAs][iGs][iAs][iGs][iTs][iTs][i$^5$Cs][iT] | 580 |
| 9 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iAs][iGs][iAs][iGs][iTs][iTs][i$^5$C] | 581 |
| 10 | GAATCTACCCACCGGGATAAGAGTTC | 10 | [iGs][iAs][iAs][iTs][i$^5$Cs][iTs][iAs][i$^5$Cs][i$^5$Cs][i$^5$Cs][iAs][i$^5$Cs][i$^5$Cs][iGs][iGs][iGs][iAs][iTs][iAs][iAs][iGs][iAs][iGs][iTs][iTs][i$^5$C] | 582 |
| 11 | CGAATCTACCCACGGGATAAGAGTTC | 11 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iGs][iGs][iAs][iTs][iAs][iAs][iGs][iAs][iGs][iTs][iTs][i$^5$C] | 583 |
| 12 | ACGAATCTACCCAGGGATAAGAGTTC | 12 | [iAs][i$^5$Cs][iGs][iAs][iAs][iTs][i$^5$Cs][iTs][iAs][i$^5$Cs][i$^5$Cs][i$^5$Cs][iAs][iGs][iGs][iGs][iAs][iTs][iAs][iAs][iGs][iAs][iGs][iTs][iTs][i$^5$C] | 584 |
| 13 | CACGAATCTACCCGGGATAAGAGTTC | 13 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iGs][iGs][iAs][iTs][iAs][iAs][iGs][iAs][iGs][iTs][iTs][i$^5$C] | 585 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 14 | CCACGAATCTACCGGGATAAGAGTTC | 14 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iGs][iGs][iAs][iTs][iAs][iAs][iGs][iAs][iGs][iTs][iTs][i$^5$C] | 586 |
| 15 | CTAGCCACGAATCGGGATAAGAGTTC | 15 | [i$^5$Cs][iTs][iAs][iGs][i$^5$Cs][i$^5$Cs][iAs][i$^5$Cs][iGs][iAs][iAs][iTs][i$^5$Cs][iGs][iGs][iGs][iAs][iTs][iAs][iAs][iGs][iAs][iGs][iTs][iTs][i$^5$C] | 587 |
| 16 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iGs][iGs][iAs][iTs][iAs][iAs][iGs][iAs][iGs][iTs][iTs][i$^5$C] | 588 |
| 17 | GCATTTATTCAACGGGGATAAGAGTT | 17 | [iGs][i$^5$Cs][iAs][iTs][iTs][iTs][iAs][iTs][iTs][i$^5$Cs][iAs][iAs][i$^5$Cs][iGs][iGs][iGs][iAs][iTs][iAs][iAs][iGs][iAs][iGs][iTs][iT] | 589 |
| 18 | CCACCAACTCATCGGGGATAAGAGTT | 18 | [i$^5$Cs][i$^5$Cs][iAs][i$^5$Cs][i$^5$Cs][iAs][iAs][i$^5$Cs][iTs][i$^5$Cs][iAs][iTs][i$^5$Cs][iGs][iGs][iGs][iGs][iAs][iTs][iAs][iAs][iGs][iAs][iGs][iTs][iT] | 590 |
| 19 | GAATCTACCCACCGGGGATAAGAGTT | 19 | [iGs][iAs][iAs][iTs][i$^5$Cs][iTs][iAs][i$^5$Cs][i$^5$Cs][i$^5$Cs][iAs][i$^5$Cs][i$^5$Cs][iGs][iGs][iGs][iGs][iAs][iTs][iAs][iAs][iGs][iAs][iGs][iTs][iT] | 591 |
| 20 | CGAATCTACCCACGGGGATAAGAGTT | 20 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iGs][iGs][iGs][iAs][iTs][iAs][iAs][iGs][iAs][iGs][iTs][iT] | 592 |
| 21 | CACGAATCTACCCGGGGATAAGAGTT | 21 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iGs][iGs][iGs][iAs][iTs][iAs][iAs][iGs][iAs][iGs][iTs][iT] | 593 |
| 22 | CCACGAATCTACCGGGGATAAGAGTT | 22 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iGs][iGs][iGs][iAs][iTs][iAs][iAs][iGs][iAs][iGs][iTs][iT] | 594 |
| 23 | GCCACGAATCTACGGGGATAAGAGTT | 23 | [iGs][i$^5$Cs][i$^5$Cs][iAs][i$^5$Cs][iGs][iAs][iAs][iTs][i$^5$Cs][iTs][iAs][i$^5$Cs][iGs][iGs][iGs][iGs][iAs][iTs][iAs][iAs][iGs][iAs][iGs][iTs][iT] | 595 |
| 24 | CGAATCTACCCACCCTGGGGATAAGA | 24 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][i$^5$Cs][iTs][iGs][iGs][iGs][iGs][iAs][iTs][iAs][iAs][iGs][iA] | 596 |
| 25 | ACGAATCTACCCATCCTGGGGATAAG | 25 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iTs][iGs][iGs][iGs][iGs][iAs][iTs][iAs][iAs][iG] | 597 |
| 26 | CGAATCTACCCACGTTCCTGGGGATA | 26 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iTs][iTs][i$^5$Cs][i$^5$Cs][iTs][iGs][iGs][iGs][iGs][iAs][iTs][iA] | 598 |
| 27 | CACGAATCTACCCGTTCCTGGGGATA | 27 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iTs][iTs][i$^5$Cs][i$^5$Cs][iTs][iGs][iGs][iGs][iGs][iAs][iTs][iA] | 599 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 28 | CTAGCCACGAATCGTTCCTGGGGATA | 28 | [i$^5$Cs][iTs][iAs][iGs][i$^5$Cs][i$^5$Cs][iAs][i$^5$Cs][iGs][iAs][iAs][iTs][i$^5$Cs][iGs][iTs][iTs][i$^5$Cs][i$^5$Cs][iTs][iGs][iGs][iGs][iGs][iAs][iTs][iA] | 600 |
| 29 | CGAATCTACCCACTAGTTCCTGGGGA | 29 | [i$^5$Cs][iGs][iAs][iAs][iTs][i$^5$Cs][iTs][iAs][i$^5$Cs][i$^5$Cs][i$^5$Cs][iAs][i$^5$Cs][iTs][iAs][iGs][iTs][iTs][i$^5$Cs][i$^5$Cs][iTs][iGs][iGs][iGs][iGs][iA] | 601 |
| 30 | CTAGCCACGAATCTAGTTCCTGGGGA | 30 | [i$^5$Cs][iTs][iAs][iGs][i$^5$Cs][i$^5$Cs][iAs][i$^5$Cs][iGs][iAs][iAs][iTs][i$^5$Cs][iTs][iAs][iGs][iTs][iTs][i$^5$Cs][i$^5$Cs][iTs][iGs][iGs][iGs][iGs][iA] | 602 |
| 31 | ACGAATCTACCCACTAGTTCCTGGGG | 31 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iTs][iAs][iGs][iTs][iTs][i$^5$Cs][i$^5$Cs][iTs][iGs][iGs][iGs][iG] | 603 |
| 32 | ATCTAGCCACGAACTAGTTCCTGGGG | 32 | [iAs][iTs][i$^5$Cs][iTs][iAs][iGs][i$^5$Cs][i$^5$Cs][iAs][i$^5$Cs][iGs][iAs][iAs][i$^5$Cs][iTs][iAs][iGs][iTs][iTs][i$^5$Cs][i$^5$Cs][iTs][iGs][iGs][iGs][iG] | 604 |
| 33 | GAATCTACCCACTCTGTTCAATCA | 33 | [iGs][iAs][iAs][iTs][i$^5$Cs][iTs][iAs][i$^5$Cs][i$^5$Cs][i$^5$Cs][iAs][i$^5$Cs][iTs][i$^5$Cs][iTs][iGs][iTs][iTs][i$^5$Cs][iAs][iAs][iTs][i$^5$Cs][iA] | 605 |
| 34 | CGAATCTACCCATCTGTTCAATCA | 34 | [i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$Cs][iA] | 606 |
| 35 | GAATCTACCCACATCTGTTCAATC | 35 | [iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$C] | 607 |
| 36 | CGAATCTACCCAATCTGTTCAATC | 36 | [i$^5$Cs][iGs][iAs][iAs][iTs][i$^5$Cs][iTs][iAs][i$^5$Cs][i$^5$Cs][i$^5$Cs][iAs][iAs][iTs][i$^5$Cs][iTs][iGs][iTs][iTs][i$^5$Cs][iAs][iAs][iTs][i$^5$C] | 608 |
| 37 | GAATCTACCCACTCTGTTCAATCA | 33 | [iGs][iAs][iAs][lTs][i$^5$Cs][iTs][iAs][i$^5$Cs][i$^5$Cs][i$^5$Cs][iAs][l$^5$Cs][iTs][i$^5$Cs][iTs][lGs][iTs][iTs][i$^5$Cs][lAs][iAs][iTs][i$^5$Cs][lA] | 609 |
| 38 | CGAATCTACCCATCTGTTCAATCA | 34 | [i$^5$Cs][iGs][iAs][lAs][iTs][i$^5$Cs][iTs][iAs][i$^5$Cs][i$^5$Cs][i$^5$Cs][1As][iTs][i$^5$Cs][iTs][lGs][iTs][iTs][i$^5$Cs][lAs][iAs][iTs][i$^5$Cs][lA] | 610 |
| 39 | GAATCTACCCACATCTGTTCAATC | 35 | [iGs][iAs][iAs][lTs][i$^5$Cs][iTs][iAs][i$^5$Cs][i$^5$Cs][i$^5$Cs][iAs][i$^5$Cs][iAs][iTs][i$^5$Cs][lTs][iGs][iTs][iTs][i$^5$Cs][iAs][iAs][iTs][l$^5$C] | 611 |
| 40 | CGAATCTACCCAATCTGTTCAATC | 36 | [i$^5$Cs][iGs][iAs][lAs][iTs][i$^5$Cs][iTs][lAs][i$^5$Cs][i$^5$Cs][i$^5$Cs][lAs][iAs][iTs][i$^5$Cs][lTs][iGs][iTs][iTs][i$^5$Cs][iAs][iAs][iTs][l$^5$C] | 612 |
| 41 | CACGAATCTACCCCCATCCATGTACT | 1 | [i$^5$Cs][iA][i$^5$C][iG][iA][iA][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iA][iT][iG][iA][iTs][l$^5$C] | 613 |
| 42 | CACGAATCTACCCCATCCATGTACTC | 3 | [i$^5$Cs][iA][i$^5$C][iG][iA][iA][iTs][i$^5$Cs][iTs][iAs][i$^5$Cs][i$^5$Cs][i$^5$Cs][i$^5$Cs][iAs][iTs][i$^5$Cs][i$^5$Cs][iAs][iT][iG][iT][iA][i$^5$C][iTs][i$^5$C] | 614 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 43 | CCATCCATCATCCGGGATAAGAGTTC | 16 | [i$^5$Cs][i$^5$C][iA][iT][i$^5$C][i$^5$C][iAs][iTs][i$^5$Cs][iAs][iTs][i$^5$Cs][i$^5$Cs][iGs][iGs][iGs][iAs][iTs][iAs][iA][iG][iA][iG][iT][iTs][i$^5$C] | 615 |
| 44 | TGTTCAATCATTCGGGATAAGAGTTC | 9 | [iTs][iG][iT][iT][i$^5$C][iA][iAs][iTs][i$^5$Cs][iAs][iTs][iTs][i$^5$Cs][iGs][iGs][iGs][iAs][iTs][iAs][iA][iG][iA][iG][iT][iTs][i$^5$C] | 616 |
| 45 | CACGAATCTACCCCCATCCATGTACT | 1 | [i$^5$Cs][iA][i$^5$C][iG][iA][iA][iTs][i$^5$Cs][iTs][iAs][i$^5$Cs][i$^5$C][i$^5$C][i$^5$C][i$^5$Cs][iAs][iTs][i$^5$Cs][i$^5$Cs][iA][iT][iG][iT][iA][i$^5$Cs][iT] | 617 |
| 46 | CACGAATCTACCCCATCCATGTACTC | 3 | [i$^5$Cs][iA][i$^5$C][iG][iA][iA][iTs][i$^5$Cs][iTs][iAs][i$^5$Cs][i$^5$C][i$^5$C][i$^5$C][iAs][iTs][i$^5$Cs][i$^5$Cs][iAs][iT][iG][iT][iA][i$^5$C][iTs][i$^5$C] | 618 |
| 47 | CCATCCATCATCCGGGATAAGAGTTC | 16 | [i$^5$Cs][i$^5$C][iA][iT][i$^5$C][i$^5$C][iAs][iTs][i$^5$Cs][iAs][iTs][i$^5$C][i$^5$C][iG][iGs][iGs][iAs][iTs][iAs][iA][iG][iA][iG][iT][iTs][i$^5$C] | 619 |
| 48 | TGTTCAATCATTCGGGATAAGAGTTC | 9 | [iTs][iG][iT][iT][i$^5$C][iA][iAs][iTs][i$^5$Cs][iAs][iTs][iT][i$^5$C][iG][iGs][iGs][iAs][iTs][iAs][iA][iG][iA][iG][iT][iTs][i$^5$C] | 620 |
| 49 | CACGAATCTACCCCCATCCATGTACT | 1 | [i$^5$Cs][iAs][i$^5$Cs][iGs][iAs][iAs][iTs][i$^5$Cs][iTs][iA][i$^5$C][i$^5$C][i$^5$C][i$^5$C][i$^5$C][iA][iTs][i$^5$Cs][i$^5$Cs][iAs][iTs][iGs][iTs][iAs][i$^5$Cs][iT] | 621 |
| 50 | CACGAATCTACCCCATCCATGTACTC | 3 | [i$^5$Cs][iAs][i$^5$Cs][iGs][iAs][iAs][iTs][i$^5$Cs][iTs][iA][i$^5$C][i$^5$C][i$^5$C][i$^5$C][iA][iT][i$^5$Cs][i$^5$Cs][iAs][iTs][iGs][iTs][iAs][i$^5$Cs][iTs][i$^5$C] | 622 |
| 51 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iA][iT][i$^5$C][i$^5$C][iG][iG][iG][iAs][iTs][iAs][iAs][iGs][iAs][iGs][iTs][iTs][i$^5$C] | 623 |
| 52 | TGTTCAATCATTCGGGATAAGAGTTC | 9 | [iTs][iGs][iTs][iTs][i$^5$Cs][iAs][iAs][iTs][i$^5$Cs][iA][iT][iT][i$^5$C][iG][iG][iG][iAs][iTs][iAs][iAs][iGs][iAs][iGs][iTs][iTs][i$^5$C] | 624 |
| 53 | CACGAATCTACCCCCATCCATGTACT | 1 | [i$^5$Cs][iAs][i$^5$Cs][iGs][iAs][iAs][iTs][i$^5$Cs][iTs][iAs][l$^5$Cs][l$^5$Cs][l$^5$Cs][l$^5$Cs][l$^5$Cs][lAs][iTs][i$^5$Cs][i$^5$Cs][iAs][iTs][iGs][iTs][iAs][i$^5$Cs][iT] | 625 |
| 54 | CACGAATCTACCCCATCCATGTACTC | 3 | [i$^5$Cs][iAs][i$^5$Cs][iGs][iAs][iAs][iTs][i$^5$Cs][iTs][iAs][l$^5$Cs][l$^5$Cs][l$^5$Cs][l$^5$Cs][lAs][lTs][i$^5$Cs][i$^5$Cs][iAs][iTs][iGs][iTs][iAs][i$^5$Cs][iTs][i$^5$C] | 626 |
| 55 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][lTs][l$^5$Cs][l$^5$Cs][lGs][lGs][lGs][iAs][iTs][iAs][iAs][iGs][iAs][iGs][iTs][iTs][i$^5$C] | 627 |
| 56 | TGTTCAATCATTCGGGATAAGAGTTC | 9 | [iTs][iGs][iTs][iTs][i$^5$Cs][iAs][iAs][iTs][i$^5$Cs][iAs][lTs][lTs][l$^5$Cs][lGs][lGs][lGs][iAs][iTs][iAs][iAs][iGs][iAs][iGs][iTs][iTs][i$^5$C] | 628 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 57 | CACGAATCTACCCCCATCCATGTACT | 1 | [l$^5$Cs][lAs][l$^5$Cs][lGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][lTs][lAs][l$^5$Cs][lT] | 629 |
| 58 | CACGAATCTACCCCATCCATGTACTC | 3 | [l$^5$Cs][lAs][l$^5$Cs][lGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][lAs][l$^5$Cs][lTs][l$^5$C] | 630 |
| 59 | CCATCCATCATCCGGGATAAGAGTTC | 16 | [l$^5$Cs][l$^5$Cs][lAs][lTs][i$^5$Cs][i$^5$Cs][iAs][iTs][i$^5$Cs][iAs][iTs][i$^5$Cs][i$^5$Cs][iGs][iGs][iGs][iAs][iTs][iAs][iAs][iGs][iAs][lGs][lTs][lTs][l$^5$C] | 631 |
| 60 | TGTTCAATCATTCGGGATAAGAGTTC | 9 | [lTs][lGs][lTs][lTs][i$^5$Cs][iAs][iAs][iTs][i$^5$Cs][iAs][iTs][iTs][i$^5$Cs][iGs][iGs][iGs][iAs][iTs][iAs][iAs][iGs][iAs][lGs][lTs][lTs][l$^5$C] | 632 |
| 61 | CACGAATCTACCCCCATCCATGTACT | 1 | [l$^5$Cs][lAs][l$^5$Cs][lGs][iAs][iAs][iTs][i$^5$Cs][iTs][iAs][i$^5$Cs][l$^5$Cs][l$^5$Cs][l$^5$Cs][l$^5$Cs][iAs][iTs][i$^5$Cs][i$^5$Cs][iAs][iTs][iGs][lTs][lAs][l$^5$Cs][lT] | 633 |
| 62 | CACGAATCTACCCCATCCATGTACTC | 3 | [l$^5$Cs][lAs][l$^5$Cs][lGs][iAs][iAs][iTs][i$^5$Cs][iTs][iAs][l$^5$Cs][l$^5$Cs][l$^5$Cs][l$^5$Cs][lAs][iTs][i$^5$Cs][i$^5$Cs][iAs][iTs][iGs][iTs][lAs][l$^5$Cs][lTs][l$^5$C] | 634 |
| 63 | CCATCCATCATCCGGGATAAGAGTTC | 16 | [l$^5$Cs][l$^5$Cs][lAs][iTs][i$^5$Cs][i$^5$Cs][iAs][iTs][i$^5$Cs][iAs][iTs][l$^5$Cs][l$^5$Cs][lGs][lGs][iGs][iAs][iTs][iAs][iAs][iGs][iAs][lGs][lTs][lTs][l$^5$C] | 635 |
| 64 | TGTTCAATCATTCGGGATAAGAGTTC | 9 | [lTs][lGs][lTs][lTs][i$^5$Cs][iAs][iAs][iTs][i$^5$Cs][iAs][iTs][lTs][l$^5$Cs][lGs][lGs][iGs][iAs][iTs][iAs][iAs][iGs][iAs][lGs][lTs][lTs][l$^5$C] | 636 |
| 65 | CACGAATCTACCCCCATCCATGTACT | 1 | [l$^5$Cs][lAs][l$^5$Cs][iGs][iAs][iAs][iTs][i$^5$Cs][iTs][iAs][l$^5$Cs][l$^5$Cs][l$^5$Cs][l$^5$Cs][l$^5$Cs][lAs][iTs][i$^5$Cs][i$^5$Cs][iAs][iTs][iGs][iTs][lAs][l$^5$Cs][lT] | 637 |
| 66 | CACGAATCTACCCCATCCATGTACTC | 3 | [l$^5$Cs][lAs][l$^5$Cs][iGs][iAs][iAs][iTs][i$^5$Cs][iTs][iAs][l$^5$Cs][l$^5$Cs][l$^5$Cs][l$^5$Cs][lAs][lTs][i$^5$Cs][i$^5$Cs][iAs][iTs][iGs][iTs][iAs][l$^5$Cs][lTs][l$^5$C] | 638 |
| 67 | CCATCCATCATCCGGGATAAGAGTTC | 16 | [l$^5$Cs][l$^5$Cs][lAs][iTs][i$^5$Cs][i$^5$Cs][iAs][iTs][i$^5$Cs][iAs][lTs][l$^5$Cs][l$^5$Cs][lGs][lGs][lGs][iAs][iTs][iAs][iAs][iGs][iAs][iGs][lTs][lTs][l$^5$C] | 639 |
| 68 | TGTTCAATCATTCGGGATAAGAGTTC | 9 | [lTs][lGs][lTs][iTs][i$^5$Cs][iAs][iAs][iTs][i$^5$Cs][iAs][lTs][lTs][l$^5$Cs][lGs][lGs][lGs][iAs][iTs][iAs][iAs][iGs][iAs][iGs][lTs][lTs][l$^5$C] | 640 |
| 69 | CACGAATCTACCCCCATCCATGTACT | 1 | [l$^5$Cs][lAs][l$^5$Cs][lGs][iAs][iAs][iTs][i$^5$Cs][iTs][iAs][l$^5$Cs][l$^5$Cs][l$^5$Cs][l$^5$Cs][l$^5$Cs][lAs][iTs][i$^5$Cs][i$^5$Cs][iAs][iTs][iGs][iTs][iAs][i$^5$Cs][lT] | 641 |
| 70 | CACGAATCTACCCCATCCATGTACTC | 3 | [l$^5$Cs][lAs][l$^5$Cs][lGs][iAs][iAs][iTs][i$^5$Cs][iTs][iAs][l$^5$Cs][l$^5$Cs][l$^5$Cs][l$^5$Cs][lAs][lTs][i$^5$Cs][i$^5$Cs][iAs][iTs][iGs][iTs][iAs][i$^5$Cs][iTs][i$^5$C] | 642 |
| 71 | CCATCCATCATCCGGGATAAGAGTTC | 16 | [l$^5$Cs][l$^5$Cs][lAs][lTs][i$^5$Cs][i$^5$Cs][iAs][iTs][i$^5$Cs][iAs][lTs][l$^5$Cs][l$^5$Cs][lGs][lGs][lGs][iAs][iTs][iAs][iAs][iGs][iAs][iGs][iTs][iTs][i$^5$C] | 643 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 72 | TGTTCAATCATTCGGGATAAGAGTTC | 9 | [lTs][lGs][lTs][lTs][i$^5$Cs][iAs][iAs][iTs][i$^5$Cs][iAs][lTs][lTs][l$^5$Cs][lGs][lGs][lGs][iAs][iTs][iAs][iAs][iGs][iAs][iGs][iTs][iTs][i$^5$C] | 644 |
| 73 | CACGAATCTACCCCCATCCATGTACT | 1 | [l$^5$Cs][iAs][i$^5$Cs][iGs][iAs][iAs][iTs][i$^5$Cs][iTs][iAs][l$^5$Cs][l$^5$Cs][l$^5$Cs][l$^5$Cs][l$^5$Cs][lAs][iTs][i$^5$Cs][i$^5$Cs][iAs][iTs][iGs][lTs][lAs][l$^5$Cs][lT] | 645 |
| 74 | CACGAATCTACCCCATCCATGTACTC | 3 | [l$^5$Cs][iAs][i$^5$Cs][iGs][iAs][iAs][iTs][i$^5$Cs][iTs][iAs][l$^5$Cs][l$^5$Cs][l$^5$Cs][l$^5$Cs][lAs][lTs][i$^5$Cs][i$^5$Cs][iAs][iTs][iGs][iTs][lAs][l$^5$Cs][lTs][l$^5$C] | 646 |
| 75 | CCATCCATCATCCGGGATAAGAGTTC | 16 | [l$^5$Cs][i$^5$Cs][iAs][iTs][i$^5$Cs][i$^5$Cs][iAs][iTs][i$^5$Cs][iAs][lTs][l$^5$Cs][l$^5$Cs][lGs][lGs][lGs][iAs][iTs][iAs][iAs][iGs][iAs][lGs][lTs][lTs][l$^5$C] | 647 |
| 76 | TGTTCAATCATTCGGGATAAGAGTTC | 9 | [iTs][iGs][iTs][iTs][i$^5$Cs][iAs][iAs][iTs][i$^5$Cs][iAs][lTs][lTs][l$^5$Cs][lGs][lGs][lGs][iAs][iTs][iAs][iAs][iGs][iAs][lGs][lTs][lTs][l$^5$C] | 648 |
| 77 | CGAATCTACCCACATCTGTTCAATCA | 2 | [i$^5$Cs][iGs][iAs][iAs][iTs][i$^5$Cs][iTs][iAs][i$^5$Cs][i$^5$Cs][l$^5$Cs][lAs][l$^5$Cs][lAs][lTs][l$^5$Cs][iTs][iGs][iTs][iTs][i$^5$Cs][iAs][iAs][iTs][i$^5$Cs][iA] | 649 |
| 78 | CGAATCTACCCACATCTGTTCAATCA | 2 | [l$^5$Cs][lGs][lAs][lAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][lAs][lTs][l$^5$Cs][lA] | 650 |
| 79 | CGAATCTACCCACATCTGTTCAATCA | 2 | [l$^5$Cs][lGs][lAs][lAs][iTs][i$^5$Cs][iTs][iAs][i$^5$Cs][i$^5$Cs][l$^5$Cs][lAs][l$^5$Cs][lAs][lTs][i$^5$Cs][iTs][iGs][iTs][iTs][i$^5$Cs][iAs][lAs][lTs][l$^5$Cs][lA] | 651 |
| 80 | ACGAATCTACCCCCATCCATGTAC | 37 | [iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$C] | 652 |
| 81 | CACGAATCTACCCCATCCATGTACT | 38 | [l$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][l$^5$Cs][lT] | 653 |
| 82 | ACGAATCTACCCCCATCCATGTACT | 39 | [iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iT] | 654 |
| 83 | CACGAATCTACCCCCATCCATGTAC | 40 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$C] | 655 |
| 84 | CACGAATCTACCCTCCATCCATGTACT | 41 | [i$^5$Cs][iAs][i$^5$Cs][iGs][iAs][iAs][iTs][i$^5$Cs][iTs][iAs][i$^5$Cs][i$^5$Cs][i$^5$Cs][iTs][i$^5$Cs][i$^5$Cs][iAs][iTs][i$^5$Cs][i$^5$Cs][iAs][iTs][iGs][iTs][iAs][i$^5$Cs][iT] | 656 |
| 85 | CACGAATCTACCCACCATCCATGTACT | 42 | [i$^5$Cs][iAs][i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][i$^5$Cs][i$^5$Cs][iAs][iTs][iGs][iTs][iAs][i$^5$Cs][iT] | 657 |

TABLE 5-continued

| ASO # | Nucleobase Sequence (5' → 3') | SEQ ID NO: | Antisense Oligonucleotide Structures (5' → 3') | SEQ ID NO: |
|---|---|---|---|---|
| Exemplary antisense oligonucleotides | | | | |
| 86 | ACGAATCTACCCCATCCATGTACT | 43 | [iAs][i5Cs][iGs][iAs][iAs][iTs][i5Cs][iTs][iAs][i5Cs][i5Cs][i5Cs][i5Cs][iAs][iTs][i5Cs][i5Cs][iAs][iTs][iGs][iTs][iAs][i5Cs][iT] | 658 |
| 87 | CACGAATCTACCCATCCATGTACTC | 44 | [i5Cs][iAs][i5Cs][iGs][iAs][iAs][iTs][i5Cs][iTs][iAs][i5Cs][i5Cs][i5Cs][iAs][iTs][i5Cs][i5Cs][iAs][iTs][iGs][iTs][iAs][i5Cs][iTs][i5C] | 659 |
| 88 | ACGAATCTACCCCATCCATGTACTC | 45 | [iAs][i5Cs][iGs][iAs][iAs][iTs][i5Cs][iTs][iAs][i5Cs][i5Cs][i5Cs][i5Cs][iAs][iTs][i5Cs][i5Cs][iAs][iTs][iGs][iTs][iAs][i5Cs][iTs][i5C] | 660 |
| 89 | CACGAATCTACCCCATCCATGTACTCA | 46 | [i5Cs][iAs][i5Cs][iGs][iAs][iAs][iTs][i5Cs][iTs][iAs][i5Cs][i5Cs][i5Cs][i5Cs][iAs][iTs][i5Cs][i5Cs][iAs][iTs][iGs][iTs][iAs][i5Cs][iTs][i5Cs][iA] | 661 |
| 90 | CCATCCATCATCGGGATAAGAGTT | 47 | [i5Cs][i5Cs][iAs][iTs][i5Cs][i5Cs][iAs][iTs][i5Cs][iAs][iTs][i5Cs][iGs][iGs][iGs][iAs][iTs][iAs][iAs][iGs][iAs][iGs][iTs][iT] | 662 |
| 91 | CCATCCATCATCGGATAAGAGTTC | 48 | [i5Cs][i5Cs][iAs][iTs][i5Cs][i5Cs][iAs][iTs][i5Cs][iAs][iTs][i5Cs][iGs][iGs][iAs][iTs][iAs][iAs][iGs][iAs][iGs][iTs][iTs][i5C] | 663 |
| 92 | CATCCATCATCCGGGATAAGAGTT | 49 | [i5Cs][iAs][iTs][i5Cs][i5Cs][iAs][iTs][i5Cs][iAs][iTs][i5Cs][i5Cs][iGs][iGs][iGs][iAs][iTs][iAs][iAs][iGs][iAs][iGs][iTs][iT] | 664 |
| 93 | CATCCATCATCCGGATAAGAGTTC | 50 | [i5Cs][iAs][iTs][i5Cs][i5Cs][iAs][iTs][i5Cs][iAs][iTs][i5Cs][i5Cs][iGs][iGs][iAs][iTs][iAs][iAs][iGs][iAs][iGs][iTs][iTs][i5C] | 665 |
| 94 | CCATCCATCATCGGGATAAGAGTTC | 51 | [i5Cs][i5Cs][iAs][iTs][i5Cs][i5Cs][iAs][iTs][i5Cs][iAs][iTs][i5Cs][iGs][iGs][iGs][iAs][iTs][iAs][iAs][iGs][iAs][iGs][iTs][iTs][i5C] | 666 |
| 95 | CATCCATCATCCGGGATAAGAGTTC | 52 | [i5Cs][iAs][iTs][i5Cs][i5Cs][iAs][iTs][i5Cs][iAs][iTs][i5Cs][i5Cs][iGs][iGs][iGs][iAs][iTs][iAs][iAs][iGs][iAs][iGs][iTs][iTs][i5C] | 667 |
| 96 | CCATCCATCATCCGGGATAAGAGTT | 53 | [i5Cs][i5Cs][iAs][iTs][i5Cs][i5Cs][iAs][iTs][i5Cs][iAs][iTs][i5Cs][i5Cs][iGs][iGs][iGs][iAs][iTs][iAs][iAs][iGs][iAs][iGs][iTs][iT] | 668 |
| 97 | CCATCCATCATCCGGATAAGAGTTC | 54 | [i5Cs][i5Cs][iAs][iTs][i5Cs][i5Cs][iAs][iTs][i5Cs][iAs][iTs][i5Cs][i5Cs][iGs][iGs][iAs][iTs][iAs][iAs][iGs][iAs][iGs][iTs][iTs][i5C] | 669 |
| 98 | CCATCCATCATCCGGGGATAAGAGTTC | 55 | [i5Cs][i5Cs][iAs][iTs][i5Cs][i5Cs][iAs][iTs][i5Cs][iAs][iTs][i5Cs][i5Cs][iGs][iGs][iGs][iGs][iAs][iTs][iAs][iAs][iGs][iAs][iGs][iTs][iTs][i5C] | 670 |
| 99 | CCATCCATCATCCGGGATAAGAGTTCT | 56 | [i5Cs][i5Cs][iAs][iTs][i5Cs][i5Cs][iAs][iTs][i5Cs][iAs][iTs][i5Cs][i5Cs][iGs][iGs][iGs][iAs][iTs][iAs][iAs][iGs][iAs][iGs][iTs][iTs][i5Cs][iT] | 671 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 100 | TCCATCCATCATCCGGGATAAGAGTTC | 57 | [iTs][i$^{5}$Cs][i$^{5}$Cs][iAs][iTs][i$^{5}$Cs][i$^{5}$Cs][iAs][iTs][i$^{5}$Cs][iAs][iTs][i$^{5}$Cs][i$^{5}$Cs][iGs][iGs][iGs][iAs][iTs][iAs][iAs][iGs][iAs][iGs][iTs][iTs][i$^{5}$C] | 672 |
| 101 | GTTCAATCATTCGGGATAAGAGTT | 58 | [iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iGs][iTs][iT] | 673 |
| 102 | GTTCAATCATTCGGATAAGAGTTC | 59 | [iGs][iTs][iTs][i$^{5}$Cs][iAs][iAs][iTs][i$^{5}$Cs][iAs][iTs][iTs][i$^{5}$Cs][iGs][iGs][iAs][iTs][iAs][iAs][iGs][iAs][iGs][iTs][iTs][i$^{5}$C] | 674 |
| 103 | GTTCAATCATTCGGGATAAGAGTTC | 60 | [iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iGs][iTs][iTs][i$^{5}$C] | 675 |
| 104 | TGTTCAATCATTCGGATAAGAGTTC | 61 | [iTs][iGs][iTs][iTs][i$^{5}$Cs][iAs][iAs][iTs][i$^{5}$Cs][iAs][iTs][iTs][i$^{5}$Cs][iGs][iGs][iAs][iTs][iAs][iAs][iGs][iAs][iGs][iTs][iTs][i$^{5}$C] | 676 |
| 105 | TGTTCAATCATTCGGGATAAGAGTTCT | 62 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iGs][iTs][iTs][i$^{5}$Cs][iT] | 677 |
| 106 | GAATCTACCCACATCTGTTCAATCA | 63 | [iGs][iAs][iAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$Cs][iAs][iAs][iTs][iCs][iA] | 678 |
| 107 | CGAATCTACCCACATCTGTTCAATC | 64 | [i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$Cs][iAs][iAs][iTs][i$^{5}$C] | 679 |
| 108 | CGAATCTACCCACCATCTGTTCAATCA | 65 | [i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][i$^{5}$Cs][iAs][iTs][i$^{5}$Cs][iTs][iGs][iTs][iTs][i$^{5}$Cs][iAs][iAs][iTs][i$^{5}$Cs][iA] | 680 |
| 109 | CACGAATCTACCCCCCATCCATGTACT | 66 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][i$^{5}$Cs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 681 |
| 110 | CACGAATCTACCCGCCATCCATGTACT | 67 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iGs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 682 |
| 111 | CACGAATCTACCCTCATCCATGTACTC | 68 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iTs][i$^{5}$Cs][iAs][iTs][i$^{5}$Cs][i$^{5}$Cs][iAs][iTs][iGs][iTs][iAs][i$^{5}$Cs][iTs][i$^{5}$C] | 683 |
| 112 | CACGAATCTACCCGCATCCATGTACTC | 69 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iGs][i$^{5}$Cs][iAs][iTs][i$^{5}$Cs][i$^{5}$Cs][iAs][iTs][iGs][iTs][iAs][i$^{5}$Cs][iTs][i$^{5}$C] | 684 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 113 | TGTTCAATCATTCCGGGATAAGAGTTC | 70 | [iTs][iGs][iTs][iTs][i$^5$Cs][iAs][iAs][iTs][i$^5$Cs][iAs][iTs][iTs][i$^5$Cs][i$^5$Cs][iGs][iGs][iGs][iAs][iTs][iAs][iAs][iGs][iAs][iGs][iTs][iTs][i$^5$C] | 685 |
| 114 | CCATCCATCATCCCGGGATAAGAGTTC | 71 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][i$^5$Cs][iGs][iGs][iGs][iAs][iTs][iAs][iAs][iGs][iAs][iGs][iTs][iTs][i$^5$C] | 686 |
| 115 | CACGAATCTACCCCACCATCCATGTACT | 72 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][i$^5$Cs][i$^5$Cs][iAs][iTs][i$^5$Cs][i$^5$Cs][iAs][iTs][iGs][iTs][iAs][i$^5$Cs][iT] | 687 |
| 116 | CACGAATCTACCCTCCCATCCATGTACT | 73 | [i$^5$Cs][iAs][i$^5$Cs][iGs][iAs][iAs][iTs][i$^5$Cs][iTs][iAs][i$^5$Cs][i$^5$Cs][i$^5$Cs][iTs][i$^5$Cs][i$^5$Cs][i$^5$Cs][iAs][iTs][i$^5$Cs][i$^5$Cs][iAs][iTs][iGs][iTs][iAs][i$^5$Cs][iT] | 688 |
| 117 | CACGAATCTACCCCCCCATCCATGTACT | 74 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iT] | 689 |
| 118 | CACGAATCTACCCCTCATCCATGTACTC | 75 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iTs][i$^5$Cs][iAs][iTs][i$^5$Cs][i$^5$Cs][iAs][iTs][iGs][iTs][iAs][i$^5$Cs][iTs][i$^5$C] | 690 |
| 119 | CACGAATCTACCCTTCATCCATGTACTC | 76 | [i$^5$Cs][iAs][i$^5$Cs][iGs][iAs][iAs][iTs][i$^5$Cs][iTs][iAs][i$^5$Cs][i$^5$Cs][i$^5$Cs][iTs][iTs][i$^5$Cs][iAs][iTs][i$^5$Cs][i$^5$Cs][iAs][iTs][iGs][iTs][iAs][i$^5$Cs][iTs][i$^5$C] | 691 |
| 120 | TGTTCAATCATTCCAGGGATAAGAGTTC | 77 | [iTs][iGs][iTs][iTs][i$^5$Cs][iAs][iAs][iTs][i$^5$Cs][iAs][iTs][iTs][i$^5$Cs][i$^5$Cs][iAs][iGs][iGs][iGs][iAs][iTs][iAs][iAs][iGs][iAs][iGs][iTs][iTs][i$^5$C] | 692 |
| 121 | TGTTCAATCATTCCTGGGATAAGAGTTC | 78 | [iTs][iGs][iTs][iTs][i$^5$Cs][iAs][iAs][iTs][i$^5$Cs][iAs][iTs][iTs][i$^5$Cs][i$^5$Cs][iTs][iGs][iGs][iGs][iAs][iTs][iAs][iAs][iGs][iAs][iGs][iTs][iTs][i$^5$C] | 693 |
| 122 | CCATCCATCATCCCAGGGATAAGAGTTC | 79 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][i$^5$Cs][iAs][iGs][iGs][iGs][iAs][iTs][iAs][iAs][iGs][iAs][iGs][iTs][iTs][i$^5$C] | 694 |
| 123 | CCATCCATCATCCTCGGGATAAGAGTTC | 80 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iTs][i$^5$Cs][iGs][iGs][iGs][iAs][iTs][iAs][iAs][iGs][iAs][iGs][iTs][iTs][i$^5$C] | 695 |
| 124 | CCATCCATCATCCTTGGGATAAGAGTTC | 81 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iTs][iTs][iGs][iGs][iGs][iAs][iTs][iAs][iAs][iGs][iAs][iGs][iTs][iTs][i$^5$C] | 696 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 125 | ACGAATCTACCCCCATCCATGTAC | 37 | [iAs][i$^{5}$Cs][iGs][iAs][iAs][iTs][i$^{5}$Cs][iTs][iAs][l$^{5}$Cs][l$^{5}$Cs][l$^{5}$Cs][l$^{5}$Cs][l$^{5}$Cs][lAs][iTs][i$^{5}$Cs][i$^{5}$Cs][iAs][iTs][iGs][iTs][iAs][i$^{5}$C] | 697 |
| 126 | ACGAATCTACCCCATCCATGTACT | 43 | [iAs][i$^{5}$Cs][iGs][iAs][iAs][iTs][i$^{5}$Cs][iTs][iAs][l$^{5}$Cs][l$^{5}$Cs][l$^{5}$Cs][l$^{5}$Cs][lAs][lTs][i$^{5}$Cs][i$^{5}$Cs][iAs][iTs][iGs][iTs][iAs][i$^{5}$Cs][iT] | 698 |
| 127 | CCATCCATCATCGGGATAAGAGTT | 47 | [i$^{5}$Cs][i$^{5}$Cs][iAs][iTs][i$^{5}$Cs][i$^{5}$Cs][iAs][iTs][i$^{5}$Cs][lAs][lTs][l$^{5}$Cs][lGs][lGs][lGs][iAs][iTs][iAs][iAs][iGs][iAs][iGs][iTs][lT] | 699 |
| 128 | CCATCCATCATCGGATAAGAGTTC | 48 | [i$^{5}$Cs][i$^{5}$Cs][iAs][iTs][i$^{5}$Cs][i$^{5}$Cs][iAs][iTs][i$^{5}$Cs][lAs][lTs][l$^{5}$Cs][lGs][lGs][lAs][iTs][iAs][iAs][iGs][iAs][iGs][iTs][iTs][i$^{5}$C] | 700 |
| 129 | CATCCATCATCCGGGATAAGAGTT | 49 | [l$^{5}$Cs][iAs][iTs][i$^{5}$Cs][i$^{5}$Cs][iAs][iTs][i$^{5}$Cs][iAs][ITs][l$^{5}$Cs][l$^{5}$Cs][lGs][lGs][lGs][iAs][iTs][iAs][iAs][iGs][iAs][iGs][iTs][lT] | 701 |
| 130 | CATCCATCATCCGGATAAGAGTTC | 50 | [l$^{5}$Cs][iAs][iTs][i$^{5}$Cs][i$^{5}$Cs][iAs][iTs][i$^{5}$Cs][iAs][lTs][l$^{5}$Cs][l$^{5}$Cs][lGs][lGs][lAs][iTs][iAs][iAs][iGs][iAs][iGs][iTs][iTs][i$^{5}$C] | 702 |
| 131 | GTTCAATCATTCGGGATAAGAGTT | 58 | [iGs][iTs][iTs][i$^{5}$Cs][iAs][iAs][iTs][i$^{5}$Cs][iAs][iTs][lTs][l$^{5}$Cs][lGs][lGs][lGs][iAs][iTs][iAs][iAs][iGs][iAs][iGs][iTs][lT] | 703 |
| 132 | GTTCAATCATTCGGATAAGAGTTC | 59 | [iGs][iTs][iTs][i$^{5}$Cs][iAs][iAs][iTs][i$^{5}$Cs][iAs][iTs][lTs][l$^{5}$Cs][lGs][lGs][lAs][iTs][iAs][iAs][iGs][iAs][iGs][iTs][iTs][i$^{5}$C] | 704 |
| 133 | CGAATCTACCCATCTGTTCAATCA | 34 | [i$^{5}$Cs][iGs][iAs][iAs][iTs][i$^{5}$Cs][iTs][iAs][i$^{5}$Cs][i$^{5}$Cs][l$^{5}$Cs][lAs][lTs][l$^{5}$Cs][lTs][iGs][iTs][iTs][i$^{5}$Cs][iAs][iAs][iTs][i$^{5}$Cs][iA] | 705 |
| 134 | CGAATCTACCCAATCTGTTCAATC | 36 | [i$^{5}$Cs][iGs][iAs][iAs][iTs][i$^{5}$Cs][iTs][iAs][i$^{5}$Cs][l$^{5}$Cs][l$^{5}$Cs][lAs][lAs][lTs][l$^{5}$Cs][iTs][iGs][iTs][iTs][i$^{5}$Cs][iAs][iAs][iTs][i$^{5}$C] | 706 |
| 135 | ACGAATCTACCCCCATCCATGTAC | 37 | [lAs][l$^{5}$Cs][lGs][lAs][iAs][iTs][i$^{5}$Cs][iTs][iAs][i$^{5}$Cs][l$^{5}$Cs][l$^{5}$Cs][l$^{5}$Cs][l$^{5}$Cs][iAs][iTs][i$^{5}$Cs][i$^{5}$Cs][iAs][iTs][lGs][lTs][lAs][l$^{5}$C] | 707 |
| 136 | ACGAATCTACCCCATCCATGTACT | 43 | [lAs][l$^{5}$Cs][lGs][lAs][iAs][iTs][i$^{5}$Cs][iTs][iAs][i$^{5}$Cs][l$^{5}$Cs][l$^{5}$Cs][l$^{5}$Cs][lAs][iTs][i$^{5}$Cs][i$^{5}$Cs][iAs][iTs][iGs][lTs][lAs][lT] | 708 |
| 137 | CCATCCATCATCGGGATAAGAGTT | 47 | [l$^{5}$Cs][l$^{5}$Cs][lAs][lTs][i$^{5}$Cs][i$^{5}$Cs][iAs][iTs][i$^{5}$Cs][iAs][lTs][l$^{5}$Cs][lGs][lGs][iGs][iAs][iTs][iAs][iAs][iGs][lAs][lGs][lTs][lT] | 709 |
| 138 | CCATCCATCATCGGATAAGAGTTC | 48 | [l$^{5}$Cs][l$^{5}$Cs][lAs][lTs][i$^{5}$Cs][i$^{5}$Cs][iAs][iTs][i$^{5}$Cs][iAs][lTs][l$^{5}$Cs][lGs][lGs][iAs][iTs][iAs][iAs][iGs][iAs][lGs][lTs][lTs][l$^{5}$C] | 710 |
| 139 | CATCCATCATCCGGGATAAGAGTT | 49 | [l$^{5}$Cs][lAs][lTs][l$^{5}$Cs][i$^{5}$Cs][iAs][iTs][i$^{5}$Cs][iAs][iTs][l$^{5}$Cs][l$^{5}$Cs][lGs][lGs][iGs][iAs][iTs][iAs][iAs][iGs][lAs][lGs][lTs][lT] | 711 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 140 | CATCCATCATCCGGATAAGAGTTC | 50 | [l$^{5}$Cs][lAs][lTs][l$^{5}$Cs][i$^{5}$Cs][iAs][iTs][i$^{5}$Cs][iAs][iTs][l$^{5}$Cs][l$^{5}$Cs][lGs][lGs][iAs][iTs][iAs][iAs][iGs][iAs][lGs][lTs][lTs][l$^{5}$C] | 712 |
| 141 | GTTCAATCATTCGGGATAAGAGTT | 58 | [lGs][lTs][lTs][l$^{5}$Cs][iAs][iAs][iTs][i$^{5}$Cs][iAs][iTs][lTs][l$^{5}$Cs][lGs][lGs][iGs][iAs][iTs][iAs][iAs][iGs][lAs][lGs][lTs][lT] | 713 |
| 142 | GTTCAATCATTCGGATAAGAGTTC | 59 | [lGs][lTs][lTs][l$^{5}$Cs][iAs][iAs][iTs][i$^{5}$Cs][iAs][iTs][lTs][l$^{5}$Cs][lGs][lGs][iAs][iTs][iAs][iAs][iGs][iAs][lGs][lTs][lTs][l$^{5}$C] | 714 |
| 143 | CGAATCTACCCATCTGTTCAATCA | 34 | [l$^{5}$Cs][lGs][lAs][lAs][iTs][i$^{5}$Cs][iTs][iAs][i$^{5}$Cs][i$^{5}$Cs][l$^{5}$Cs][lAs][lTs][l$^{5}$Cs][iTs][iGs][iTs][iTs][i$^{5}$Cs][iAs][lAs][lTs][l$^{5}$Cs][lA] | 715 |
| 144 | CGAATCTACCCAATCTGTTCAATC | 36 | [l$^{5}$Cs][lGs][lAs][lAs][iTs][i$^{5}$Cs][iTs][iAs][i$^{5}$Cs][i$^{5}$Cs][l$^{5}$Cs][lAs][lAs][lTs][i$^{5}$Cs][iTs][iGs][iTs][iTs][i$^{5}$Cs][lAs][lAs][lTs][l$^{5}$C] | 716 |
| 145 | CGAATCTACCATCCATGTAC | 82 | [i$^{5}$Cs][iGs][iAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$C] | 717 |
| 146 | CGAATCTACCCACATCTGTTCAATCA | 2 | [i$^{5}$Cs][iG][iA][iA][iT][i$^{5}$C][iTs][iAs][i$^{5}$Cs][i$^{5}$Cs][i$^{5}$Cs][iAs][i$^{5}$Cs][iAs][iTs][i$^{5}$Cs][iTs][iGs][iTs][iT][i$^{5}$C][iA][iA][iT][i$^{5}$Cs][iA] | 718 |
| 147 | CGAATCTACCCACATCTGTTCAATCA | 2 | [i$^{5}$Cs][iG][iA][iA][iT][i$^{5}$C][iTs][iAs][i$^{5}$Cs][i$^{5}$Cs][i$^{5}$Cs][iA][i$^{5}$C][iA][iTs][i$^{5}$Cs][iTs][iGs][iTs][iT][i$^{5}$C][iA][iA][iT][i$^{5}$Cs][iA] | 719 |
| 148 | CGAATCTACCCACATCTGTTCAATCA | 2 | [i$^{5}$Cs][iGs][iAs][iAs][iTs][i$^{5}$Cs][iTs][iAs][i$^{5}$Cs][i$^{5}$C][i$^{5}$C][iA][i$^{5}$C][iA][iT][i$^{5}$C][iTs][iGs][iTs][iTs][i$^{5}$Cs][iAs][iAs][iTs][i$^{5}$Cs][iA] | 720 |
| 149 | CGAATCTACCCACATCTGTTCAATCA | 2 | [i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iT][i$^{5}$C][iA][iA][iT][i$^{5}$Cs][iA] | 721 |
| 150 | CGAATCTACCCACATCTGTTCAATCA | 2 | [i$^{5}$Cs][iG][iA][iA][iT][i$^{5}$C][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][iTs][i$^{5}$Cs][iAs][iAs][iTs][i$^{5}$Cs][iA] | 722 |
| 151 | CGAATCTACCCACATCTGTTCAATCA | 2 | [i$^{5}$Cs][iG][iA][iA][iT][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$C][iA][iA][iT][i$^{5}$Cs][iA] | 723 |
| 152 | CGAATCTACCCACATCTGTTCAATCA | 2 | [i$^{5}$Cs][iG][iA][iA][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$Cs][iA][iA][lT][i$^{5}$Cs][iA] | 724 |
| 153 | CGAATCTACCCACATCTGTTCAATCA | 2 | [i$^{5}$Cs][iG][iAs][iA][iTs][i$^{5}$C][iTs][iA][i$^{5}$Cs][i$^{5}$C][i$^{5}$Cs][iA][i$^{5}$Cs][iA][iTs][i$^{5}$C][iTs][iG][iTs][iT][i$^{5}$Cs][iAs][iAs][iTs][i$^{5}$Cs][iA] | 725 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 154 | AATCTACCCACCTGTTCAATCA | 83 | [lAs][lAs][iTs][l$^5$Cs][iTs][iAs][i$^5$Cs][i$^5$Cs][i$^5$Cs][lAs][l$^5$Cs][l$^5$Cs][lTs][iGs][iTs][iTs][i$^5$Cs][iAs][iAs][iTs][l$^5$Cs][lA] | 726 |
| 155 | AATCTACCCACATCTGTTCAAT | 84 | [lAs][lAs][iTs][i$^5$Cs][iTs][iAs][i$^5$Cs][i$^5$Cs][i$^5$Cs][lAs][l$^5$Cs][lAs][lTs][i$^5$Cs][iTs][iGs][iTs][iTs][i$^5$Cs][iAs][lAs][lT] | 727 |
| 156 | CGAATCTACCCCTGTTCAATCA | 85 | [l$^5$Cs][lGs][iAs][iAs][iTs][i$^5$Cs][iTs][iAs][i$^5$Cs][l$^5$Cs][l$^5$Cs][l$^5$Cs][lTs][iGs][iTs][iTs][i$^5$Cs][iAs][iAs][iTs][l$^5$Cs][lA] | 728 |
| 157 | CGAATCTACCCATCTGTTCAAT | 86 | [l$^5$Cs][lGs][iAs][iAs][iTs][i$^5$Cs][iTs][iAs][i$^5$Cs][l$^5$Cs][l$^5$Cs][lAs][lTs][l$^5$Cs][iTs][iGs][iTs][iTs][i$^5$Cs][iAs][lAs][lT] | 729 |
| 158 | ACGAATCTACCCAATCTGTTCAATCA | 87 | [iAs][i$^5$Cs][iGs][iAs][iAs][iTs][i$^5$Cs][iTs][iAs][i$^5$Cs][i$^5$Cs][i$^5$Cs][iAs][iAs][iTs][i$^5$Cs][iTs][iGs][iTs][iTs][i$^5$Cs][iAs][iAs][iTs][i$^5$Cs][iA] | 730 |
| 159 | CACGAATCTACCCATCTGTTCAATCA | 88 | [i$^5$Cs][iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$Cs][iA] | 731 |
| 160 | GAATCTACCCACCATCTGTTCAATCA | 89 | [iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][i$^5$Cs][iTs][iGs][iTs][iTs][i$^5$Cs][iAs][iAs][iTs][i$^5$Cs][iA] | 732 |
| 161 | AATCTACCCACCAATCTGTTCAATCA | 90 | [iAs][iAs][iTs][i$^5$Cs][iTs][iAs][i$^5$Cs][i$^5$Cs][i$^5$Cs][iAs][i$^5$Cs][i$^5$Cs][iAs][iAs][iTs][i$^5$Cs][iTs][iGs][iTs][iTs][i$^5$Cs][iAs][iAs][iTs][i$^5$Cs][iA] | 733 |
| 162 | CGAATCTACCCACTCTGTTCAATCAT | 91 | [i$^5$Cs][iGs][iAs][iAs][iTs][i$^5$Cs][iTs][iAs][i$^5$Cs][i$^5$Cs][i$^5$Cs][iAs][i$^5$Cs][iTs][i$^5$Cs][iTs][iGs][iTs][iTs][i$^5$Cs][iAs][iAs][iTs][i$^5$Cs][iAs][iT] | 734 |
| 163 | CGAATCTACCCACTCATCTGTTCAAT | 92 | [i$^5$Cs][iGs][iAs][iAs][iTs][i$^5$Cs][iTs][iAs][i$^5$Cs][i$^5$Cs][i$^5$Cs][iAs][i$^5$Cs][iTs][i$^5$Cs][iAs][iTs][i$^5$Cs][iTs][iGs][iTs][iTs][i$^5$Cs][iAs][iAs][iT] | 735 |
| 164 | ACGAATCTACCCACATCTGTTCAATC | 93 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$C] | 736 |
| 165 | GAATCTACCCACCCATCTGTTCAATC | 94 | [iGs][iAs][iAs][iTs][i$^5$Cs][iTs][iAs][i$^5$Cs][i$^5$Cs][i$^5$Cs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$C] | 737 |
| 166 | ACGAATCTACCCATCTGTTCAATCAT | 95 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$Cs][iAs][iT] | 738 |
| 167 | GAATCTACCCACCTCTGTTCAATCAT | 96 | [iGs][iAs][iAs][iTs][i$^5$Cs][iTs][iAs][i$^5$Cs][i$^5$Cs][i$^5$Cs][iAs][i$^5$Cs][i$^5$Cs][iTs][i$^5$Cs][iTs][iGs][iTs][iTs][iTs][i$^5$Cs][iAs][iAs][iTs][i$^5$Cs][iAs][iT] | 739 |
| 168 | CCACGAATCTACCTCAATCATTCATT | 97 | [i$^5$Cs][i$^5$Cs][iAs][i$^5$Cs][iGs][iAs][iAs][iTs][i$^5$Cs][iTs][iAs][i$^5$Cs][i$^5$Cs][iTs][i$^5$Cs][iAs][iAs][iTs][i$^5$Cs][iAs][iTs][iTs][i$^5$Cs][iAs][iTs][iT] | 740 |

TABLE 5-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 169 | CGAATCTACCCACCTCTGTTCAATCA | 98 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iTs][i$^5$Cs][iTs][iGs][iTs][iTs][i$^5$Cs][iAs][iAs][iTs][i$^5$Cs][iA] | 741 |
| 170 | ACGAATCTACCCACTCTGTTCAATCA | 99 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iTs][i$^5$Cs][iTs][iGs][iTs][iTs][i$^5$Cs][iAs][iAs][iTs][i$^5$Cs][iA] | 742 |
| 171 | CGAATCTACCCAATCTGTTCAATCAT | 100 | [i$^5$Cs][iGs][iAs][iAs][iTs][i$^5$Cs][iTs][iAs][i$^5$Cs][i$^5$Cs][i$^5$Cs][iAs][iAs][iTs][i$^5$Cs][iTs][iGs][iTs][iTs][i$^5$Cs][iAs][iAs][iTs][i$^5$Cs][iAs][iT] | 743 |
| 172 | GAATCTACCCACATCTGTTCAATCAT | 101 | [iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iAs][iT] | 744 |
| 173 | AATCTACCCACCTGTTCAATCA | 83 | [iAs][iAs][iTs][i$^5$Cs][iTs][iAs][i$^5$Cs][i$^5$Cs][i$^5$Cs][iAs][i$^5$Cs][i$^5$Cs][iTs][iGs][iTs][iTs][i$^5$Cs][iAs][iAs][iTs][i$^5$Cs][iA] | 745 |
| 174 | AATCTACCCACATCTGTTCAAT | 84 | [iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iT] | 746 |
| 175 | AATCTACCCACTCTGTTCAATC | 102 | [iAs][iAs][iTs][i$^5$Cs][iTs][iAs][i$^5$Cs][i$^5$Cs][i$^5$Cs][iAs][i$^5$Cs][iTs][i$^5$Cs][iTs][iGs][iTs][iTs][i$^5$Cs][iAs][iAs][iTs][i$^5$C] | 747 |
| 176 | CGAATCTACCCCTGTTCAATCA | 85 | [i$^5$Cs][iGs][iAs][iAs][iTs][i$^5$Cs][iTs][iAs][i$^5$Cs][i$^5$Cs][i$^5$Cs][i$^5$Cs][iTs][iGs][iTs][iTs][i$^5$Cs][iAs][iAs][iTs][i$^5$Cs][iA] | 748 |
| 177 | CGAATCTACCCATCTGTTCAAT | 86 | [i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iT] | 749 |
| 178 | CGAATCTACCCTCTGTTCAATC | 103 | [i$^5$Cs][iGs][iAs][iAs][iTs][i$^5$Cs][iTs][iAs][i$^5$Cs][i$^5$Cs][i$^5$Cs][iTs][i$^5$Cs][iTs][iGs][iTs][iTs][i$^5$Cs][iAs][iAs][iTs][i$^5$C] | 750 |
| 179 | GAATCTACCCACTGTTCAATCA | 104 | [iGs][iAs][iAs][iTs][i$^5$Cs][iTs][iAs][i$^5$Cs][i$^5$Cs][i$^5$Cs][iAs][i$^5$Cs][iTs][iGs][iTs][iTs][i$^5$Cs][iAs][iAs][iTs][i$^5$Cs][iA] | 751 |
| 180 | GAATCTACCCAATCTGTTCAAT | 105 | [iGs][iAs][iAs][iTs][i$^5$Cs][iTs][iAs][i$^5$Cs][i$^5$Cs][i$^5$Cs][iAs][iAs][iTs][i$^5$Cs][iTs][iGs][iTs][iTs][i$^5$Cs][iAs][iAs][iT] | 752 |
| 181 | GAATCTACCCATCTGTTCAATC | 106 | [iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$C] | 753 |
| 182 | AATCTACCCACTCTGTTCAATC | 102 | [lAs][lAs][iTs][i$^5$Cs][iTs][iAs][i$^5$Cs][i$^5$Cs][i$^5$Cs][lAs][l$^5$Cs][lTs][l$^5$Cs][iTs][iGs][iTs][iTs][i$^5$Cs][iAs][iAs][lTs][l$^5$C] | 754 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 183 | CGAATCTACCCTCTGTTCAATC | 103 | [l5Cs][lGs][iAs][iAs][iTs][i5Cs][iTs][iAs][i5Cs][l5Cs][l5Cs][lTs][l5Cs][iTs][iGs][iTs][iTs][i5Cs][iAs][iAs][lTs][l5C] | 755 |
| 184 | GAATCTACCCACTGTTCAATCA | 104 | [lGs][lAs][iAs][iTs][i5Cs][iTs][iAs][i5Cs][i5Cs][l5Cs][lAs][l5Cs][lTs][iGs][iTs][iTs][i5Cs][iAs][iAs][iTs][l5Cs][lA] | 756 |
| 185 | GAATCTACCCAATCTGTTCAAT | 105 | [lGs][lAs][iAs][iTs][i5Cs][iTs][iAs][i5Cs][i5Cs][l5Cs][lAs][lAs][lTs][i5Cs][iTs][iGs][iTs][iTs][i5Cs][iAs][lAs][lT] | 757 |
| 186 | GAATCTACCCATCTGTTCAATC | 106 | [lGs][lAs][iAs][iTs][i5Cs][iTs][iAs][i5Cs][i5Cs][l5Cs][lAs][lTs][l5Cs][iTs][iGs][iTs][iTs][i5Cs][iAs][iAs][lTs][l5C] | 758 |
| 187 | GAATCTACCCATCTGTTCAATC | 106 | [iGs][A][iA][lT][i5C][iTs][iAs][i5Cs][i5Cs][i5Cs][iAs][iTs][i5Cs][iTs][iGs][iTs][lT][i5C][iA][iA][iTs][i5C] | 759 |
| 188 | GAATCTACCCATCTGTTCAATC | 106 | [iGs][iAs][iAs][iTs][i5Cs][iTs][iAs][i5Cs][i5Cs][i5Cs][iAs][iTs][i5Cs][iTs][iGs][iT][iT][i5C][iA][iA][iTs][i5C] | 760 |
| 189 | GAATCTACCCATCTGTTCAATC | 106 | [iGs][iAs][iAs][iTs][i5Cs][iTs][iAs][i5Cs][i5Cs][i5Cs][iA][iT][i5Cs][iTs][iGs][iTs][iTs][i5C][iA][iA][iTs][i5C] | 761 |
| 190 | GAATCTACCCATCTGTTCAATC | 106 | [iGs][iA][iA][iTs][i5Cs][iTs][iAs][i5Cs][i5Cs][i5C][iA][iT][i5C][iTs][iGs][iTs][iTs][i5Cs][iA][iA][iTs][i5C] | 762 |
| 191 | GAATCTACCCATCTGTTCAATC | 106 | [lGs][A][iA][lT][i5C][iTs][iAs][i5Cs][i5Cs][l5Cs][lAs][lTs][l5Cs][iTs][iGs][iTs][iT][i5C][iA][iA][lTs][i5C] | 763 |
| 192 | CGAATCTACCCAATCTGTTCAATC | 36 | [i5Cs][iGs][iAs][lAs][iTs][i5Cs][iTs][iAs][i5Cs][i5Cs][l5Cs][lAs][lAs][lTs][i5Cs][iTs][iGs][iTs][iTs][i5Cs][lAs][iAs][iTs][l5C] | 764 |
| 193 | CGAATCTACCCAATCTGTTCAATC | 36 | [i5Cs][iGs][iAs][lAs][iTs][i5Cs][iTs][iAs][i5Cs][i5Cs][i5Cs][lAs][lAs][iTs][i5Cs][iTs][iGs][iTs][iTs][i5Cs][lAs][iAs][iTs][i5C] | 765 |
| 194 | CGAATCTACCCAATCTGTTCAATC | 36 | [l5Cs][lGs][iAs][iAs][iTs][i5Cs][iTs][iAs][i5Cs][i5Cs][i5Cs][lAs][lAs][iTs][i5Cs][iTs][iGs][iTs][iTs][i5Cs][iAs][iAs][lTs][l5C] | 766 |
| 195 | CGAATCTACCCACTCATCTGTTCAAT | 92 | [i5Cs][iG][iA][iA][iT][i5Cs][iTs][iAs][i5Cs][i5Cs][i5Cs][iAs][i5Cs][iTs][i5Cs][iAs][iTs][i5Cs][iTs][iGs][iT][iT][i5C][iA][iAs][iT] | 767 |
| 196 | CGAATCTACCCACTCATCTGTTCAAT | 92 | [i5Cs][iG][iA][iA][iTs][i5Cs][iTs][iAs][i5Cs][i5Cs][i5Cs][iAs][i5Cs][iTs][i5Cs][iAs][iTs][i5Cs][iTs][iGs][iTs][iT][i5C][iA][iAs][iT] | 768 |
| 197 | ACGAATCTACCCACATCTGTTCAATC | 93 | [iAs][i5C][iG][iA][iA][iTs][i5Cs][iTs][iAs][i5Cs][i5Cs][i5Cs][iAs][i5Cs][iAs][iTs][i5Cs][iTs][iGs][iTs][iT][i5C][iA][iTs][i5C] | 769 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 198 | ACGAATCTACCCACATCTGTTCAATC | 93 | [iAs][i$^5$C][iG][iA][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$C][iA][iA][iTs][i$^5$C] | 770 |
| 199 | CAAATCTACCCACATCTGTTCAATCA | 107 | [i$^5$Cs][iAs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] | 771 |
| 200 | CGAATCTACCCACATCTATTCAATCA | 108 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iAs][iTs][iTs][i$^5$Cs][iAs][iAs][iTs][i$^5$Cs][iA] | 772 |
| 201 | CAAATCTACCCACATCTATTCAATCA | 109 | [i$^5$Cs][iAs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iAs][iTs][iTs][i$^5$Cs][iAs][iAs][iTs][i$^5$Cs][iA] | 773 |
| 202 | CGAATCTACCCAATCTATTCAATC | 110 | [l$^5$Cs][lGs][lAs][lAs][iTs][i$^5$Cs][iTs][iAs][i$^5$Cs][i$^5$Cs][l$^5$Cs][lAs][lAs][lTs][i$^5$Cs][iTs][iAs][iTs][iTs][i$^5$Cs][lAs][lAs][lTs][l$^5$C] | 774 |
| 203 | CGAATCTACCCACATCTGTTCAAT | 111 | [l$^5$Cs][lGs][lAs][lAs][iTs][i$^5$Cs][iTs][iAs][i$^5$Cs][i$^5$Cs][l$^5$Cs][lAs][l$^5$Cs][lAs][iTs][i$^5$Cs][iTs][iGs][iTs][iTs][l$^5$Cs][lAs][lAs][lT] | 775 |
| 204 | CGAATCTACCCATCATCTGTTCAA | 112 | [l$^5$Cs][lGs][lAs][lAs][iTs][i$^5$Cs][iTs][iAs][i$^5$Cs][i$^5$Cs][l$^5$Cs][lAs][lTs][l$^5$Cs][iAs][iTs][i$^5$Cs][iTs][iGs][iTs][lTs][l$^5$Cs][lAs][lA] | 776 |
| 205 | ACGAATCTACCCATCTGTTCAATC | 113 | [lAs][l$^5$Cs][lGs][lAs][iAs][iTs][i$^5$Cs][iTs][iAs][l$^5$Cs][l$^5$Cs][l$^5$Cs][lAs][lTs][i$^5$Cs][iTs][iGs][iTs][iTs][i$^5$Cs][lAs][lAs][lTs][l$^5$C] | 777 |
| 206 | ACGAATCTACCCCATCTGTTCAAT | 114 | [lAs][l$^5$Cs][lGs][lAs][iAs][iTs][i$^5$Cs][iTs][iAs][l$^5$Cs][l$^5$Cs][l$^5$Cs][l$^5$Cs][lAs][iTs][i$^5$Cs][iTs][iGs][iTs][lTs][l$^5$Cs][lAs][lAs][iT] | 778 |
| 207 | CACGAATCTACCCATCCATGTACT | 115 | [l$^5$Cs][lAs][l$^5$Cs][lGs][iAs][iAs][iTs][i$^5$Cs][iTs][iAs][l$^5$Cs][l$^5$Cs][l$^5$Cs][lAs][iTs][i$^5$Cs][i$^5$Cs][iAs][iTs][iGs][lTs][lAs][l$^5$Cs][lT] | 779 |
| 208 | CACGAATCTACCCCATCCATGTAC | 116 | [l$^5$Cs][lAs][l$^5$Cs][lGs][iAs][iAs][iTs][i$^5$Cs][iTs][iAs][l$^5$Cs][l$^5$Cs][l$^5$Cs][l$^5$Cs][iAs][iTs][i$^5$Cs][i$^5$Cs][iAs][iTs][lGs][lTs][lAs][l$^5$C] | 780 |
| 209 | CATTTATTCAACGGGATAAGAGTT | 117 | [l$^5$Cs][lAs][lTs][lTs][iTs][iAs][iTs][iTs][i$^5$Cs][iAs][lAs][l$^5$Cs][lGs][lGs][iGs][iAs][iTs][iAs][iAs][iGs][lAs][lGs][lTs][lT] | 781 |
| 210 | CATTTATTCAACGGGGATAAGAGT | 118 | [l$^5$Cs][lAs][lTs][lTs][iTs][iAs][iTs][iTs][i$^5$Cs][iAs][lAs][l$^5$Cs][lGs][lGs][iGs][iGs][iAs][iTs][iAs][iAs][lGs][lAs][lGs][lT] | 782 |
| 211 | CGAATCTACCCACATCTGTTCAATCA | 2 | [i$^5$Cs][iG][iA][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] | 783 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 212 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$C][iA][i$^5$Cs][iAs][iTs][i$^5$Cs][iTs][iGs][iTs][iTs][i$^5$Cs][iAs][iAs][iTs][i$^5$Cs][iA] | 784 |
| 213 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iT][i$^5$C][iTs][iGs][iTs][iTs][i$^5$Cs][iAs][iAs][iTs][i$^5$Cs][iA] | 785 |
| 214 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iA][iT][i$^5$Cs][iA] | 786 |
| 215 | CGAATCTACCCAATCTGTTCAATC | 36 | [l$^5$Cs][lGs][iAs][iAs][iTs][i$^5$Cs][lTs][lAs][i$^5$Cs][i$^5$Cs][i$^5$Cs][iAs][iAs][iTs][i$^5$Cs][iTs][iGs][lTs][iTs][i$^5$Cs][iAs][iAs][lTs][l$^5$C] | 787 |
| 216 | CGAATCTACCCAATCTGTTCAATC | 36 | [l$^5$Cs][iGs][iAs][iAs][iTs][i$^5$Cs][iTs][iAs][i$^5$Cs][i$^5$Cs][i$^5$Cs][iAs][lAs][lTs][l$^5$Cs][iTs][iGs][iTs][iTs][i$^5$Cs][iAs][iAs][lTs][l$^5$C] | 788 |
| 217 | CGAATCTACCCAATCTGTTCAATC | 36 | [l$^5$Cs][lGs][iAs][iAs][iTs][i$^5$Cs][iTs][iAs][i$^5$Cs][i$^5$Cs][i$^5$Cs][lAs][iAs][iTs][i$^5$Cs][iTs][iGs][iTs][iTs][i$^5$Cs][iAs][iAs][iTs][i$^5$C] | 789 |
| 218 | CGAATCTACCCAATCTGTTCAATC | 36 | [l$^5$Cs][iGs][iAs][iAs][iTs][l$^5$Cs][iTs][iAs][i$^5$Cs][i$^5$Cs][i$^5$Cs][lAs][lAs][iTs][i$^5$Cs][iTs][iGs][iTs][lTs][i$^5$Cs][iAs][iAs][iTs][i$^5$C] | 790 |
| 219 | CGAATCTACCCAATCTGTTCAATC | 36 | [l$^5$Cs][lG][lA][lAs][iTs][i$^5$Cs][iTs][iAs][i$^5$Cs][i$^5$Cs][l$^5$Cs][lAs][lAs][lTs][i$^5$Cs][iTs][iGs][iTs][iTs][i$^5$Cs][lAs][lAs][lTs][l$^5$C] | 791 |
| 220 | CGAATCTACCCAATCTGTTCAATC | 36 | [l$^5$Cs][lGs][lAs][lAs][iTs][i$^5$Cs][iTs][iAs][i$^5$Cs][i$^5$C][l$^5$C][lAs][lAs][lTs][i$^5$Cs][iTs][iGs][iTs][iTs][i$^5$Cs][lAs][lAs][lTs][l$^5$C] | 792 |
| 221 | CGAATCTACCCAATCTGTTCAATC | 36 | [l$^5$Cs][lGs][lAs][lAs][iTs][i$^5$Cs][iTs][iAs][i$^5$Cs][i$^5$Cs][l$^5$Cs][lAs][lAs][lT][i$^5$C][iTs][iGs][iTs][iTs][i$^5$Cs][lAs][lAs][lTs][l$^5$C] | 793 |
| 222 | CGAATCTACCCAATCTGTTCAATC | 36 | [l$^5$Cs][lGs][lAs][lAs][iTs][i$^5$Cs][iTs][iAs][i$^5$Cs][i$^5$Cs][l$^5$Cs][lAs][lAs][lTs][i$^5$Cs][iTs][iGs][iTs][iTs][i$^5$Cs][lA][lA][lTs][l$^5$C] | 794 |
| 223 | CACGAATCTACCCCCATCCATGTACT | 1 | [i$^5$Cs][iA][i$^5$C][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iT] | 795 |
| 224 | CACGAATCTACCCCCATCCATGTACT | 1 | [i$^5$Cs][iAs][i$^5$Cs][iGs][iAs][iAs][iTs][i$^5$Cs][iTs][iAs][i$^5$C][i$^5$C][i$^5$Cs][i$^5$Cs][i$^5$Cs][iAs][iTs][i$^5$Cs][i$^5$Cs][iAs][iTs][iGs][iTs][iAs][i$^5$Cs][iT] | 796 |
| 225 | CACGAATCTACCCCCATCCATGTACT | 1 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$C][iA][iTs][i$^5$Cs][i$^5$Cs][iAs][iTs][iGs][iTs][iAs][i$^5$Cs][iT] | 797 |
| 226 | CACGAATCTACCCCCATCCATGTACT | 1 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iT][iA][i$^5$Cs][iT] | 798 |

TABLE 5-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 227 | CCATCCATCATCCGGGATAAGAGTTC | 16 | [i$^5$Cs][i$^5$C][iA][iTs][i$^5$Cs][i$^5$Cs][iAs][iTs][i$^5$Cs][iAs][iTs][i$^5$Cs][i$^5$Cs][iGs][iGs][iGs][iAs][iTs][iAs][iAs][iGs][iAs][iGs][iTs][iTs][i$^5$C] | 799 |
| 228 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][iT][i$^5$C][i$^5$Cs][iGs][iGs][iGs][iAs][iTs][iAs][iAs][iGs][iAs][iGs][iTs][iTs][i$^5$C] | 800 |
| 229 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iG][iG][iAs][iTs][iAs][iAs][iGs][iAs][iGs][iTs][iTs][i$^5$C] | 801 |
| 230 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iGs][iGs][iAs][iTs][iAs][iAs][iGs][iAs][iG][iT][iTs][i$^5$C] | 802 |
| 231 | GCATTTATTCAACGGGGATAAGAGTT | 17 | [iGs][i$^5$C][iA][iTs][iTs][iTs][iAs][iTs][iTs][i$^5$Cs][iAs][iAs][i$^5$Cs][iGs][iGs][iGs][iGs][iAs][iTs][iAs][iAs][iGs][iAs][iGs][iTs][iT] | 803 |
| 232 | GCATTTATTCAACGGGGATAAGAGTT | 17 | [iGs][i$^5$Cs][iAs][iTs][iTs][iTs][iAs][iTs][iTs][i$^5$Cs][iA][iA][i$^5$Cs][iGs][iGs][iGs][iGs][iAs][iTs][iAs][iAs][iGs][iAs][iGs][iTs][iT] | 804 |
| 233 | GCATTTATTCAACGGGGATAAGAGTT | 17 | [iGs][i$^5$Cs][iAs][iTs][iTs][iTs][iAs][iTs][iTs][i$^5$Cs][iAs][iAs][i$^5$Cs][iGs][iG][iG][iGs][iAs][iTs][iAs][iAs][iGs][iAs][iGs][iTs][iT] | 805 |
| 234 | GCATTTATTCAACGGGGATAAGAGTT | 17 | [iGs][i$^5$Cs][iAs][iTs][iTs][iTs][iAs][iTs][iTs][i$^5$Cs][iAs][iAs][i$^5$Cs][iGs][iGs][iGs][iGs][iAs][iTs][iAs][iAs][iGs][iA][iG][iTs][iT] | 806 |
| 235 | CGAATCTACCATCCATGTAC | 82 | [i$^5$Cs][iGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$C] | 807 |
| 236 | ATCCATCCATCATTGGGGATAAGAGT | 119 | [iAs][iTs][i$^5$Cs][i$^5$Cs][iAs][iTs][i$^5$Cs][i$^5$Cs][iAs][iTs][i$^5$Cs][iAs][iTs][iTs][iGs][iGs][iGs][iGs][iAs][iTs][iAs][iAs][iGs][iAs][iGs][iT] | 808 |
| 237 | TCCATCCATCATCGGGGATAAGAGTT | 120 | [iTs][i$^5$Cs][i$^5$Cs][iAs][iTs][i$^5$Cs][i$^5$Cs][iAs][iTs][i$^5$Cs][iAs][iTs][i$^5$Cs][iGs][iGs][iGs][iGs][iAs][iTs][iAs][iAs][iGs][iAs][iGs][iTs][iT] | 809 |
| 238 | TCCATCCATCATCGGGATAAGAGTTC | 121 | [iTs][i$^5$Cs][i$^5$Cs][iAs][iTs][i$^5$Cs][i$^5$Cs][iAs][iTs][i$^5$Cs][iAs][iTs][i$^5$Cs][iGs][iGs][iGs][iAs][iTs][iAs][iAs][iGs][iAs][iGs][iTs][iTs][i$^5$C] | 810 |
| 239 | TCCATCCATCATCGGATAAGAGTTCT | 122 | [iTs][i$^5$Cs][i$^5$Cs][iAs][iTs][i$^5$Cs][i$^5$Cs][iAs][iTs][i$^5$Cs][iAs][iTs][i$^5$Cs][iGs][iGs][iAs][iTs][iAs][iAs][iGs][iAs][iGs][iTs][iTs][i$^5$Cs][iT] | 811 |
| 240 | CCATCCATCATCCGATAAGAGTTCTT | 123 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iAs][iTs][iAs][iAs][iGs][iAs][iGs][iTs][iTs][i$^5$Cs][iTs][iT] | 812 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 241 | GCATTTATTCAACGGGATAAGAGTTC | 124 | [iGs][i$^5$Cs][iAs][iTs][iTs][iTs][iAs][iTs][iTs][i$^5$Cs][iAs][iAs][i$^5$Cs][iGs][iGs][iGs][iAs][iTs][iAs][iAs][iGs][iAs][iGs][iTs][iTs][i$^5$C] | 813 |
| 242 | GCATTTATTCAACGGATAAGAGTTCT | 125 | [iGs][i$^5$Cs][iAs][iTs][iTs][iTs][iAs][iTs][iTs][i$^5$Cs][iAs][iAs][i$^5$Cs][iGs][iGs][iAs][iTs][iAs][iAs][iGs][iAs][iGs][iTs][iTs][i$^5$Cs][iT] | 814 |
| 243 | CGAATCTACCCACCCTTTTATCTACT | 126 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][i$^5$Cs][iTs][iTs][iTs][iTs][iAs][iTs][i$^5$Cs][iTs][iAs][i$^5$Cs][iT] | 815 |
| 244 | CGAATCTACCCACCATGTACTCACCC | 127 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][iGs][iTs][iAs][i$^5$Cs][iTs][i$^5$Cs][iAs][i$^5$Cs][i$^5$Cs][i$^5$C] | 816 |
| 245 | CACGAATCTACCCCCATCCTTTTATC | 128 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iTs][iTs][iTs][iTs][iAs][iTs][i$^5$C] | 817 |
| 246 | CACGAATCTACCCCTGTTCAATCATT | 129 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iTs][iGs][iTs][iTs][i$^5$Cs][iAs][iAs][iTs][i$^5$Cs][iAs][iTs][iT] | 818 |
| 247 | CACGAATCTACCCGTTCAATCATTCA | 130 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iTs][iTs][i$^5$Cs][iAs][iAs][iTs][i$^5$Cs][iAs][iTs][iTs][i$^5$Cs][iA] | 819 |
| 248 | CGAATCTACCCACTCCTTTTATCTAC | 131 | [i$^5$Cs][iGs][iAs][iAs][iTs][i$^5$Cs][iTs][iAs][i$^5$Cs][i$^5$Cs][i$^5$Cs][iAs][i$^5$Cs][iTs][i$^5$Cs][i$^5$Cs][iTs][iTs][iTs][iTs][iAs][iTs][i$^5$Cs][iTs][iAs][i$^5$C] | 820 |
| 249 | CGAATCTACCCACCTGTTCAATCATT | 132 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iTs][iGs][iTs][iTs][i$^5$Cs][iAs][iAs][iTs][i$^5$Cs][iAs][iTs][iT] | 821 |
| 250 | CGAATCTACCCACCTTTTATCTACTC | 133 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iTs][iTs][iTs][iTs][iAs][iTs][i$^5$Cs][iTs][iAs][i$^5$Cs][iTs][i$^5$C] | 822 |
| 251 | CGAATCTACCCACGTTCAATCATTCA | 134 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iTs][iTs][i$^5$Cs][iAs][iAs][iTs][i$^5$Cs][iAs][iTs][iTs][i$^5$Cs][iA] | 823 |
| 252 | ACGAATCTACCCAGTACTCACCCATC | 135 | [iAs][i$^5$Cs][iGs][iAs][iAs][iTs][i$^5$Cs][iTs][iAs][i$^5$Cs][i$^5$Cs][i$^5$Cs][iAs][iGs][iTs][iAs][i$^5$Cs][iTs][i$^5$Cs][iAs][i$^5$Cs][i$^5$Cs][i$^5$Cs][iAs][iTs][i$^5$C] | 824 |
| 253 | CGAATCTACCCACTGTTCAATCATTC | 136 | [i$^5$Cs][iGs][iAs][iAs][iTs][i$^5$Cs][iTs][iAs][i$^5$Cs][i$^5$Cs][i$^5$Cs][iAs][i$^5$Cs][iTs][iGs][iTs][iTs][i$^5$Cs][iAs][iAs][iTs][i$^5$Cs][iAs][iTs][iTs][i$^5$C] | 825 |
| 254 | CACGAATCTACCCCATCTGTTCAATC | 137 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][iTs][iGs][iTs][iTs][i$^5$Cs][iAs][iAs][iTs][i$^5$C] | 826 |

TABLE 5-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 255 | CACGAATCTACCCCCTTTTATCTACT | 138 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iTs][iTs][iTs][iTs][iAs][iTs][i$^5$Cs][iTs][iAs][i$^5$Cs][iT] | 827 |
| 256 | CACGAATCTACCCCCATGTACTCACC | 139 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][iGs][iTs][iAs][i$^5$Cs][iTs][i$^5$Cs][iAs][i$^5$Cs][i$^5$C] | 828 |
| 257 | CGAATCTACCCACATTCACCAGCATT | 140 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][iTs][i$^5$Cs][iAs][i$^5$Cs][i$^5$Cs][iAs][iGs][i$^5$Cs][iAs][iTs][iT] | 829 |
| 258 | CGAATCTACCCACCATCTGTTCAATC | 141 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][i$^5$Cs][iTs][iGs][iTs][iTs][i$^5$Cs][iAs][iAs][iTs][i$^5$C] | 830 |
| 259 | ACGAATCTACCCACCATCCTTTTATC | 142 | [iAs][i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][i$^5$Cs][i$^5$Cs][iTs][iTs][iTs][iTs][iAs][iTs][i$^5$C] | 831 |
| 260 | CGAATCTACCCACGTACTCACCCATC | 143 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iTs][iAs][i$^5$Cs][iTs][i$^5$Cs][iAs][i$^5$Cs][i$^5$Cs][i$^5$Cs][iAs][iTs][i$^5$C] | 832 |
| 261 | CACGAATCTACCCGTACTCACCCATC | 144 | [i$^5$Cs][iAs][i$^5$Cs][iGs][iAs][iAs][iTs][i$^5$Cs][iTs][iAs][i$^5$Cs][i$^5$Cs][i$^5$Cs][iGs][iTs][iAs][i$^5$Cs][iTs][i$^5$Cs][iAs][i$^5$Cs][i$^5$Cs][i$^5$Cs][iAs][iTs][i$^5$C] | 833 |
| 262 | ACGAATCTACCCAATTCACCAGCATT | 145 | [iAs][i$^5$Cs][iGs][iAs][iAs][iTs][i$^5$Cs][iTs][iAs][i$^5$Cs][i$^5$Cs][i$^5$Cs][iAs][iAs][iTs][iTs][i$^5$Cs][iAs][i$^5$Cs][i$^5$Cs][iAs][iGs][i$^5$Cs][iAs][iTs][iT] | 834 |
| 263 | CGAATCTACCCACGAAACCCAGGCAG | 146 | [i$^5$Cs][iGs][iAs][iAs][iTs][i$^5$Cs][iTs][iAs][i$^5$Cs][i$^5$Cs][i$^5$Cs][iAs][i$^5$Cs][iGs][iAs][iAs][iAs][i$^5$Cs][i$^5$Cs][i$^5$Cs][iAs][iGs][iGs][i$^5$Cs][iAs][iG] | 835 |
| 264 | CCACGAATCTACCGGAAACCCAGGCA | 147 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iGs][iAs][iAs][iAs][i$^5$Cs][i$^5$Cs][i$^5$Cs][iAs][iGs][iGs][i$^5$Cs][iA] | 836 |
| 265 | CAATCATATATCCGGAAACCCAGGCA | 148 | [i$^5$Cs][iAs][iAs][iTs][i$^5$Cs][iAs][iTs][iAs][iTs][iAs][iTs][i$^5$Cs][i$^5$Cs][iGs][iGs][iAs][iAs][iAs][i$^5$Cs][i$^5$Cs][i$^5$Cs][iAs][iGs][iGs][i$^5$Cs][iA] | 837 |
| 266 | CAATAGTTCAATCGGAAACCCAGGCA | 149 | [i$^5$Cs][iAs][iAs][iTs][iAs][iGs][iTs][iTs][i$^5$Cs][iAs][iAs][iTs][i$^5$Cs][iGs][iGs][iAs][iAs][iAs][i$^5$Cs][i$^5$Cs][i$^5$Cs][iAs][iGs][iGs][i$^5$Cs][iA] | 838 |
| 267 | TCTAGCCACGAATTTCCAGGAAACCC | 150 | [iTs][i$^5$Cs][iTs][iAs][iGs][i$^5$Cs][i$^5$Cs][iAs][i$^5$Cs][iGs][iAs][iAs][iTs][iTs][iTs][i$^5$Cs][i$^5$Cs][iAs][iGs][iGs][iAs][iAs][iAs][i$^5$Cs][i$^5$Cs][i$^5$C] | 839 |
| 268 | GTACTCACCCATCGATAAGAGTTCTT | 151 | [iGs][iTs][iAs][i$^5$Cs][iTs][i$^5$Cs][iAs][i$^5$Cs][i$^5$Cs][i$^5$Cs][iAs][iTs][i$^5$Cs][iGs][iAs][iTs][iAs][iAs][iGs][iAs][iGs][iTs][iTs][i$^5$Cs][iTs][iT] | 840 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 269 | CCATGTACTCACCGGATAAGAGTTCT | 152 | [i$^5$Cs][i$^5$Cs][iAs][iTs][iGs][iTs][iAs][i$^5$Cs][iTs][i$^5$Cs][iAs][i$^5$Cs][i$^5$Cs][iGs][iGs][iAs][iTs][iAs][iAs][iGs][iAs][iGs][iTs][iTs][i$^5$Cs][iT] | 841 |
| 270 | TGTCCATCCATCCGGATAAGAGTTCT | 153 | [iTs][iGs][iTs][i$^5$Cs][i$^5$Cs][iAs][iTs][i$^5$Cs][i$^5$Cs][iAs][iTs][i$^5$Cs][i$^5$Cs][iGs][iGs][iAs][iTs][iAs][iAs][iGs][iAs][iGs][iTs][iTs][i$^5$Cs][iT] | 842 |
| 271 | TTCATTCACCAGCGGGATAAGAGTTC | 154 | [iTs][iTs][i$^5$Cs][iAs][iTs][iTs][i$^5$Cs][iAs][i$^5$Cs][i$^5$Cs][iAs][iGs][i$^5$Cs][iGs][iGs][iGs][iAs][iTs][iAs][iAs][iGs][iAs][iGs][iTs][iTs][i$^5$C] | 843 |
| 272 | CTACTCATCACTCGGGATAAGAGTTC | 155 | [i$^5$Cs][iTs][iAs][i$^5$Cs][iTs][i$^5$Cs][iAs][iTs][i$^5$Cs][iAs][i$^5$Cs][iTs][i$^5$Cs][iGs][iGs][iGs][iAs][iTs][iAs][iAs][iGs][iAs][iGs][iTs][iTs][i$^5$C] | 844 |
| 273 | TCTCCATCCATCCGGGATAAGAGTTC | 156 | [iTs][i$^5$Cs][iTs][i$^5$Cs][i$^5$Cs][iAs][iTs][i$^5$Cs][i$^5$Cs][iAs][iTs][i$^5$Cs][i$^5$Cs][iGs][iGs][iGs][iAs][iTs][iAs][iAs][iGs][iAs][iGs][iTs][iTs][i$^5$C] | 845 |
| 274 | GTACTCACCCATCGGGATAAGAGTTC | 157 | [iGs][iTs][iAs][i$^5$Cs][iTs][i$^5$Cs][iAs][i$^5$Cs][i$^5$Cs][i$^5$Cs][iAs][iTs][i$^5$Cs][iGs][iGs][iGs][iAs][iTs][iAs][iAs][iGs][iAs][iGs][iTs][iTs][i$^5$C] | 846 |
| 275 | CATGTACTCACCCGGGATAAGAGTTC | 158 | [i$^5$Cs][iAs][iTs][iGs][iTs][iAs][i$^5$Cs][iTs][i$^5$Cs][iAs][i$^5$Cs][i$^5$Cs][i$^5$Cs][iGs][iGs][iGs][iAs][iTs][iAs][iAs][iGs][iAs][iGs][iTs][iTs][i$^5$C] | 847 |
| 276 | CATCCATCTATCCGGGATAAGAGTTC | 159 | [i$^5$Cs][iAs][iTs][i$^5$Cs][i$^5$Cs][iAs][iTs][i$^5$Cs][iTs][iAs][iTs][i$^5$Cs][i$^5$Cs][iGs][iGs][iGs][iAs][iTs][iAs][iAs][iGs][iAs][iGs][iTs][iTs][i$^5$C] | 848 |
| 277 | CCATCCATCTGTCGGGATAAGAGTTC | 160 | [i$^5$Cs][i$^5$Cs][iAs][iTs][i$^5$Cs][i$^5$Cs][iAs][iTs][i$^5$Cs][iTs][iGs][iTs][i$^5$Cs][iGs][iGs][iGs][iAs][iTs][iAs][iAs][iGs][iAs][iGs][iTs][iTs][i$^5$C] | 849 |
| 278 | CCAGCATTTATTCGGGGATAAGAGTT | 161 | [i$^5$Cs][i$^5$Cs][iAs][iGs][i$^5$Cs][iAs][iTs][iTs][iTs][iAs][iTs][iTs][i$^5$Cs][iGs][iGs][iGs][iGs][iAs][iTs][iAs][iGs][iAs][iGs][iTs][iT] | 850 |
| 279 | TTCATTCACCAGCGGGGATAAGAGTT | 162 | [iTs][iTs][i$^5$Cs][iAs][iTs][iTs][i$^5$Cs][iAs][i$^5$Cs][i$^5$Cs][iAs][iGs][i$^5$Cs][iGs][iGs][iGs][iGs][iAs][iTs][iAs][iAs][iGs][iAs][iGs][iTs][iT] | 851 |
| 280 | TGTTCAATCATTCGGGGATAAGAGTT | 163 | [iTs][iGs][iTs][iTs][i$^5$Cs][iAs][iAs][iTs][i$^5$Cs][iAs][iTs][iTs][i$^5$Cs][iGs][iGs][iGs][iGs][iAs][iTs][iAs][iAs][iGs][iAs][iGs][iTs][iT] | 852 |
| 281 | TTATCTACTCATCGGGGATAAGAGTT | 164 | [iTs][iTs][iAs][iTs][i$^5$Cs][iTs][iAs][i$^5$Cs][iTs][i$^5$Cs][iAs][iTs][i$^5$Cs][iGs][iGs][iGs][iGs][iAs][iTs][iAs][iAs][iGs][iAs][iGs][iTs][iT] | 853 |
| 282 | CACCCATCTCTCCGGGGATAAGAGTT | 165 | [i$^5$Cs][iAs][i$^5$Cs][i$^5$Cs][i$^5$Cs][iAs][iTs][i$^5$Cs][iTs][i$^5$Cs][iTs][i$^5$Cs][i$^5$Cs][iGs][iGs][iGs][iGs][iAs][iTs][iAs][iAs][iGs][iAs][iGs][iTs][iT] | 854 |
| 283 | GTACTCACCCATCGGGGATAAGAGTT | 166 | [iGs][iTs][iAs][i$^5$Cs][iTs][i$^5$Cs][iAs][i$^5$Cs][i$^5$Cs][i$^5$Cs][iAs][iTs][i$^5$Cs][iGs][iGs][iGs][iGs][iAs][iTs][iAs][iAs][iGs][iAs][iGs][iTs][iT] | 855 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 284 | CATGTACTCACCCGGGGATAAGAGTT | 167 | [i$^5$Cs][iAs][iTs][iGs][iTs][iAs][i$^5$Cs][iTs][i$^5$Cs][iAs][i$^5$Cs][i$^5$Cs][i$^5$Cs][iGs][iGs][iGs][iGs][iAs][iTs][iAs][iAs][iGs][iAs][iGs][iTs][iT] | 856 |
| 285 | CCATCTATCCATCGGGGATAAGAGTT | 168 | [i$^5$Cs][i$^5$Cs][iAs][iTs][i$^5$Cs][iTs][iAs][iTs][i$^5$Cs][i$^5$Cs][iAs][iTs][i$^5$Cs][iGs][iGs][iGs][iGs][iAs][iTs][iAs][iAs][iGs][iAs][iGs][iTs][iT] | 857 |
| 286 | CATCCATCTAGCCGGGGATAAGAGTT | 169 | [i$^5$Cs][iAs][iTs][i$^5$Cs][i$^5$Cs][iAs][iTs][i$^5$Cs][iTs][iAs][iGs][i$^5$Cs][i$^5$Cs][iGs][iGs][iGs][iGs][iAs][iTs][iAs][iAs][iGs][iAs][iGs][iTs][iT] | 858 |
| 287 | CTGTCCATCCATCGGGGATAAGAGTT | 170 | [i$^5$Cs][iTs][iGs][iTs][i$^5$Cs][i$^5$Cs][iAs][iTs][i$^5$Cs][i$^5$Cs][iAs][iTs][i$^5$Cs][iGs][iGs][iGs][iGs][iAs][iTs][iAs][iAs][iGs][iAs][iGs][iTs][iT] | 859 |
| 288 | CAATCATATATCCGGGGATAAGAGTT | 171 | [i$^5$Cs][iAs][iAs][iTs][i$^5$Cs][iAs][iTs][iAs][iTs][iAs][iTs][i$^5$Cs][i$^5$Cs][iGs][iGs][iGs][iGs][iAs][iTs][iAs][iAs][iGs][iAs][iGs][iTs][iT] | 860 |
| 289 | CCATCTAGCCACGTTCCTGGGGATAA | 172 | [i$^5$Cs][i$^5$Cs][iAs][iTs][i$^5$Cs][iTs][iAs][iGs][i$^5$Cs][i$^5$Cs][iAs][i$^5$Cs][iGs][iTs][iTs][i$^5$Cs][i$^5$Cs][iTs][iGs][iGs][iGs][iGs][iAs][iTs][iAs][iA] | 861 |
| 290 | CATGTACTCACCCGTTCCTGGGGATA | 173 | [i$^5$Cs][iAs][iTs][iGs][iTs][iAs][i$^5$Cs][iTs][i$^5$Cs][iAs][i$^5$Cs][i$^5$Cs][i$^5$Cs][iGs][iTs][iTs][i$^5$Cs][i$^5$Cs][iTs][iGs][iGs][iGs][iGs][iAs][iTs][iA] | 862 |
| 291 | CTAGCCACGAATCACTAGTTCCTGGG | 174 | [i$^5$Cs][iTs][iAs][iGs][i$^5$Cs][i$^5$Cs][iAs][i$^5$Cs][iGs][iAs][iAs][iTs][i$^5$Cs][iAs][i$^5$Cs][iTs][iAs][iGs][iTs][iTs][i$^5$Cs][i$^5$Cs][iTs][iGs][iGs][iG] | 863 |
| 292 | CCACGAATCTACCGCATTTATTCAAC | 175 | [i$^5$Cs][i$^5$Cs][iAs][i$^5$Cs][iGs][iAs][iAs][iTs][i$^5$Cs][iTs][iAs][i$^5$Cs][i$^5$Cs][iGs][i$^5$Cs][iAs][iTs][iTs][iTs][iAs][iTs][iTs][i$^5$Cs][iAs][iAs][i$^5$C] | 864 |
| 293 | CTAGCCACGAATCGTACTCACCCATC | 176 | [i$^5$Cs][iTs][iAs][iGs][i$^5$Cs][i$^5$Cs][iAs][i$^5$Cs][iGs][iAs][iAs][iTs][i$^5$Cs][iGs][iTs][iAs][i$^5$Cs][iTs][i$^5$Cs][iAs][i$^5$Cs][i$^5$Cs][i$^5$Cs][iAs][iTs][i$^5$C] | 865 |
| 294 | GAATCTACCCACTTCACCAGCATT | 177 | [iGs][iAs][iAs][iTs][i$^5$Cs][iTs][iAs][i$^5$Cs][i$^5$Cs][i$^5$Cs][iAs][i$^5$Cs][iTs][iTs][i$^5$Cs][iAs][i$^5$Cs][i$^5$Cs][iAs][iGs][i$^5$Cs][iAs][iTs][iT] | 866 |
| 295 | CGAATCTACCCATTCACCAGCATT | 178 | [i$^5$Cs][iGs][iAs][iAs][iTs][i$^5$Cs][iTs][iAs][i$^5$Cs][i$^5$Cs][i$^5$Cs][iAs][iTs][iTs][i$^5$Cs][iAs][i$^5$Cs][i$^5$Cs][iAs][iGs][i$^5$Cs][iAs][iTs][iT] | 867 |
| 296 | GAATCTACCCACATTCACCAGCAT | 179 | [iGs][iAs][iAs][iTs][i$^5$Cs][iTs][iAs][i$^5$Cs][i$^5$Cs][i$^5$Cs][iAs][i$^5$Cs][iAs][iTs][iTs][i$^5$Cs][iAs][i$^5$Cs][i$^5$Cs][iAs][iGs][i$^5$Cs][iAs][iT] | 868 |
| 297 | CGAATCTACCCAATTCACCAGCAT | 180 | [i$^5$Cs][iGs][iAs][iAs][iTs][i$^5$Cs][iTs][iAs][i$^5$Cs][i$^5$Cs][i$^5$Cs][iAs][iAs][iTs][iTs][i$^5$Cs][iAs][i$^5$Cs][i$^5$Cs][iAs][iGs][i$^5$Cs][iAs][iT] | 869 |

TABLE 5-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 298 | GAATCTACCCACTTCACCAGCATT | 177 | [iGs][iAs][iAs][lTs][i$^5$Cs][iTs][iAs][i$^5$Cs][i$^5$Cs][i$^5$Cs][iAs][i$^5$Cs][iTs][iTs][i$^5$Cs][lAs][i$^5$Cs][i$^5$Cs][iAs][iGs][i$^5$Cs][iAs][iTs][lT] | 870 |
| 299 | CGAATCTACCCATTCACCAGCATT | 178 | [i$^5$Cs][iGs][iAs][lAs][iTs][i$^5$Cs][iTs][lAs][i$^5$Cs][i$^5$Cs][i$^5$Cs][lAs][iTs][iTs][i$^5$Cs][lAs][i$^5$Cs][i$^5$Cs][iAs][lGs][i$^5$Cs][iAs][iTs][lT] | 871 |
| 300 | GAATCTACCCACATTCACCAGCAT | 179 | [iGs][iAs][iAs][lTs][i$^5$Cs][iTs][iAs][i$^5$Cs][i$^5$Cs][i$^5$Cs][iAs][i$^5$Cs][iAs][iTs][iTs][l$^5$Cs][iAs][i$^5$Cs][i$^5$Cs][lAs][iGs][i$^5$Cs][iAs][lT] | 872 |
| 301 | CGAATCTACCCAATTCACCAGCAT | 180 | [i$^5$Cs][iGs][iAs][lAs][iTs][i$^5$Cs][iTs][lAs][i$^5$Cs][i$^5$Cs][i$^5$Cs][iAs][iAs][iTs][iTs][l$^5$Cs][iAs][i$^5$Cs][i$^5$Cs][iAs][iGs][i$^5$Cs][iAs][lT] | 873 |
| 302 | CGAATCTACCCACATTCACCAGCATT | 140 | [i$^5$Cs][iGs][iAs][iAs][iTs][i$^5$Cs][iTs][iAs][i$^5$Cs][i$^5$Cs][l$^5$Cs][lAs][l$^5$Cs][lAs][lTs][lTs][i$^5$Cs][iAs][i$^5$Cs][i$^5$Cs][iAs][iGs][i$^5$Cs][iAs][iTs][lT] | 874 |
| 303 | CGAATCTACCCACATTCACCAGCATT | 140 | [l$^5$Cs][lGs][lAs][lAs][iTs][i$^5$Cs][iTs][iAs][i$^5$Cs][i$^5$Cs][i$^5$Cs][iAs][i$^5$Cs][iAs][iTs][iTs][i$^5$Cs][iAs][i$^5$Cs][i$^5$Cs][iAs][iGs][l$^5$Cs][lAs][lTs][lT] | 875 |
| 304 | CGAATCTACCCACATTCACCAGCATT | 140 | [l$^5$Cs][lGs][lAs][lAs][iTs][i$^5$Cs][iTs][iAs][i$^5$Cs][i$^5$Cs][i$^5$Cs][lAs][l$^5$Cs][lAs][lTs][iTs][i$^5$Cs][iAs][i$^5$Cs][i$^5$Cs][iAs][iGs][l$^5$Cs][lAs][lTs][lT] | 876 |
| 305 | GAATCTACCCACATTCACCAGCATT | 181 | [iGs][iAs][iAs][iTs][i$^5$Cs][iTs][iAs][i$^5$Cs][i$^5$Cs][i$^5$Cs][iAs][i$^5$Cs][iAs][iTs][iTs][i$^5$Cs][iAs][i$^5$Cs][i$^5$Cs][iAs][iGs][i$^5$Cs][iAs][iTs][iT] | 877 |
| 306 | CGAATCTACCCACATTCACCAGCAT | 182 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][iTs][i$^5$Cs][iAs][i$^5$Cs][i$^5$Cs][iAs][iGs][i$^5$Cs][iAs][iT] | 878 |
| 307 | CGAATCTACCCATTCACCAGCATT | 178 | [i$^5$Cs][iGs][iAs][iAs][iTs][i$^5$Cs][iTs][iAs][i$^5$Cs][l$^5$Cs][l$^5$Cs][lAs][lTs][lTs][i$^5$Cs][iAs][i$^5$Cs][i$^5$Cs][iAs][iGs][l$^5$Cs][lAs][lTs][lT] | 879 |
| 308 | CGAATCTACCCATTCACCAGCATT | 178 | [l$^5$Cs][lGs][lAs][lAs][iTs][i$^5$Cs][iTs][iAs][i$^5$Cs][i$^5$Cs][i$^5$Cs][lAs][lTs][lTs][i$^5$Cs][iAs][i$^5$Cs][i$^5$Cs][iAs][iGs][l$^5$Cs][lAs][lTs][lT] | 880 |
| 309 | CATATATCCATCTAGCCACG | 183 | [l$^5$Cs][iAs][iTs][iAs][iTs][iAs][iTs][i$^5$Cs][i$^5$Cs][iAs][iTs][i$^5$Cs][iTs][iAs][iGs][i$^5$Cs][i$^5$Cs][iAs][i$^5$Cs][iG] | 881 |
| 310 | ACGAATCTACCCATCCATGT | 184 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iT] | 882 |
| 311 | TGTCCATCCACGAATCTACC | 185 | [iTs][iGs][iTs][i$^5$Cs][i$^5$Cs][iAs][iTs][i$^5$Cs][i$^5$Cs][iAs][i$^5$Cs][iGs][iAs][iAs][iTs][i$^5$Cs][iTs][iAs][i$^5$Cs][i$^5$C] | 883 |
| 312 | CGAATCTACCAACTCATCCA | 186 | [i$^5$Cs][iGs][iAs][iAs][iTs][i$^5$Cs][iTs][iAs][i$^5$Cs][i$^5$Cs][iAs][iAs][i$^5$Cs][iTs][i$^5$Cs][iAs][iTs][i$^5$Cs][i$^5$Cs][iA] | 884 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 313 | ACGAATCTACCATCCATGTA | 187 | [iAs][i$^5$Cs][iGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iA] | 885 |
| 314 | CGAATCTACCCATCTCTCCA | 188 | [i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][i$^5$Cs][iTs][i$^5$Cs][i$^5$Cs][iA] | 886 |
| 315 | CACGAATCTACCCATCTCTC | 189 | [i$^5$Cs][iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][i$^5$Cs][iTs][i$^5$C] | 887 |
| 316 | ACGAATCTACCCATCTCTCC | 190 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][i$^5$Cs][iTs][i$^5$Cs][i$^5$C] | 888 |
| 317 | CGAATCTACCATCCATGTAC | 82 | [l$^5$Cs][lG][iA][iAs][iTs][i$^5$Cs][iTs][iAs][i$^5$Cs][i$^5$Cs][iAs][iTs][i$^5$Cs][i$^5$Cs][iAs][iTs][iGs][iTs][lAs][l$^5$C] | 889 |
| 318 | CGAATCTACCATCCATGTAC | 82 | [l$^5$Cs][lGs][iAs][iAs][iTs][i$^5$Cs][iTs][iA][i$^5$Cs][i$^5$Cs][iAs][iTs][i$^5$Cs][i$^5$Cs][iAs][iTs][iGs][iTs][lAs][l$^5$C] | 890 |
| 319 | CGAATCTACCATCCATGTAC | 82 | [l$^5$Cs][lGs][iAs][iAs][iTs][i$^5$Cs][iTs][iAs][i$^5$Cs][i$^5$Cs][iAs][iT][i$^5$C][i$^5$Cs][iAs][iTs][iGs][iTs][lAs][l$^5$C] | 891 |
| 320 | CGAATCTACCATCCATGTAC | 82 | [l$^5$Cs][lGs][iAs][iAs][iTs][i$^5$Cs][iTs][iAs][i$^5$Cs][i$^5$Cs][iAs][iTs][i$^5$Cs][i$^5$Cs][iAs][iTs][iG][iT][iAs][i$^5$C] | 892 |
| 321 | CGAATCTACCATCCATGTAC | 82 | [l$^5$Cs][lGs][iAs][iAs][iTs][i$^5$Cs][iTs][iAs][i$^5$Cs][l$^5$Cs][iAs][iTs][i$^5$Cs][i$^5$Cs][iAs][iTs][iGs][iTs][lAs][l$^5$C] | 893 |
| 322 | CGAATCTACCATCCATGTAC | 82 | [l$^5$Cs][lGs][iAs][iAs][iTs][i$^5$Cs][iTs][iAs][i$^5$Cs][l$^5$Cs][iAs][iTs][i$^5$Cs][i$^5$Cs][iAs][iTs][iGs][iTs][iAs][i$^5$C] | 894 |
| 323 | CGAATCTACCATCCATGTAC | 82 | [i$^5$Cs][iGs][iAs][iAs][iTs][i$^5$Cs][iTs][iAs][i$^5$Cs][i$^5$Cs][lAs][lTs][i$^5$Cs][i$^5$Cs][iAs][iTs][iGs][iTs][lAs][l$^5$C] | 895 |
| 324 | CGAATCTACCATCCATGTAC | 82 | [l$^5$Cs][lGs][iAs][iAs][iTs][i$^5$Cs][iTs][iAs][i$^5$Cs][l$^5$Cs][lAs][lTs][i$^5$Cs][i$^5$Cs][iAs][iTs][iGs][iTs][lAs][l$^5$C] | 896 |
| 325 | CGAATCTACCATCCATGTAC | 82 | [l$^5$Cs][lGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$C] | 897 |
| 326 | CGAATCTACCATCCATGTAC | 82 | [i$^5$Cs][iGs][iAs][iAs][iTs][i$^5$Cs][iTs][iAs][i$^5$Cs][i$^5$Cs][iAs][iTs][i$^5$Cs][i$^5$Cs][iAs][iGs][iTs][iTs][iAs][i$^5$C] | 898 |
| 327 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iA][iA][iT][i$^5$Cs][iA] | 899 |

TABLE 5-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 328 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$C][iA][iA][iT][i$^5$Cs][iA] | 900 |
| 329 | CACGAATCTACCCCCATCCATGTACT | 1 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$C][iA][iT][iG][iT][iA][i$^5$Cs][iT] | 901 |
| 330 | CCATCCATCATCCGGGATAAGAGTTC | 16 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iGs][iGs][iAs][iTs][iAs][iA][iG][iA][iG][iT][iTs][i$^5$C] | 902 |
| 331 | GCATTTATTCAACGGGGATAAGAGTT | 17 | [iGs][i$^5$Cs][iAs][iTs][iTs][iTs][iAs][iTs][iTs][i$^5$Cs][iAs][iAs][i$^5$Cs][iGs][iGs][iGs][iGs][iAs][iTs][iA][iA][iG][iA][iG][iTs][iT] | 903 |

iA, iG, i$^5$C, and iT are 2'-O-methoxyethyl (2'-MOE) modified adenosine, guanosine, 5'-methyl cytidine, and thymidine, respectively; lA, lG, l$^5$C, and lT are 2'-4' methylene bridge (LNA) modified adenosine, guanosine, 5'-methyl cytidine, and thymidine, respectively; s is a phosphorothioate internucleoside linkage, and the absence of s between two nucleosides indicate a phosphodiester internucleoside linkage.

†Each 5'-methyl cytidine (5C) in any of the sequences provided in Table 5 may independently and optionally be replaced with
cytidine.

TABLE 11

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 350 | GCATTTATTCAACGGGGATAAGAGTT | 17 | [lGs][l$^5$Cs][iAs][iTs][iTs][iTs][iAs][iTs][iTs][i$^5$Cs][iAs][iAs][i$^5$Cs][iGs][iGs][iGs][iGs][iAs][iTs][iAs][iAs][iGs][iAs][iGs][lTs][lT] | 904 |
| 351 | GCATTTATTCAACGGGGATAAGAGTT | 17 | [iGs][l$^5$C][lA][iTs][iTs][iTs][iAs][iTs][iTs][i$^5$Cs][iAs][iAs][i$^5$Cs][iGs][iGs][iGs][iGs][iAs][iTs][iAs][iAs][iGs][iAs][iGs][lTs][lT] | 905 |
| 352 | GCATTTATTCAACGGGATAAGAGTTC | 124 | [iGs][i$^5$C][iA][iTs][iTs][iTs][iAs][iTs][iTs][i$^5$Cs][iAs][iAs][i$^5$Cs][iGs][iGs][iGs][iAs][iTs][iAs][iAs][iGs][iAs][iGs][iTs][iTs][i$^5$C] | 906 |
| 353 | GCATTTATTCAACGGGATAAGAGTTC | 124 | [iGs][i$^5$Cs][iAs][iTs][iTs][iTs][iAs][iTs][iTs][i$^5$Cs][iA][iA][i$^5$Cs][iGs][iGs][iGs][iAs][iTs][iAs][iAs][iGs][iAs][iGs][iTs][iTs][i$^5$C] | 907 |
| 354 | GCATTTATTCAACGGGATAAGAGTTC | 124 | [iGs][i$^5$Cs][iAs][iTs][iTs][iTs][iAs][iTs][iTs][i$^5$Cs][iAs][iAs][i$^5$Cs][iGs][iG][iG][iAs][iTs][iAs][iAs][iGs][iAs][iGs][iTs][iTs][i$^5$C] | 908 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 355 | GCATTTATTCAACGGGATAAGAGTTC | 124 | [iGs][i$^{5}$Cs][iAs][iTs][iTs][iTs][iAs][iTs][iTs][i$^{5}$Cs][iAs][iAs][i$^{5}$Cs][iGs][iGs][iGs][iAs][iTs][iAs][iAs][iGs][iAs][iG][iT][iTs][i$^{5}$C] | 909 |
| 356 | GCATTTATTCAACGGGATAAGAGTTC | 124 | [iGs][i$^{5}$Cs][iAs][iTs][iTs][iTs][iAs][iTs][iTs][i$^{5}$Cs][iAs][iAs][i$^{5}$Cs][iGs][iGs][iGs][iAs][iTs][iAs][iA][iG][iA][iG][iT][iTs][i$^{5}$C] | 910 |
| 357 | GCATTTATTCAACGGATAAGAGTTCT | 125 | [iGs][i$^{5}$Cs][iAs][iTs][iTs][iTs][iAs][iTs][iTs][i$^{5}$Cs][iAs][iAs][i$^{5}$Cs][iGs][iGs][iAs][iTs][iAs][iAs][iG][iA][iG][iT][iT][i$^{5}$Cs][iT] | 911 |
| 358 | CATTTATTCAACGGATAAGAGTTC | 338 | [l$^{5}$Cs][lAs][lTs][lTs][iTs][iAs][iTs][iTs][i$^{5}$Cs][iAs][lAs][l$^{5}$Cs][lGs][lGs][iAs][iTs][iAs][iAs][iGs][iAs][lGs][lTs][lTs][l$^{5}$C] | 912 |
| 359 | CATTTATTCAACGGATAAGAGTTC | 338 | [i$^{5}$Cs][iAs][iTs][iTs][iTs][iAs][iTs][iTs][i$^{5}$Cs][iAs][iAs][i$^{5}$Cs][iGs][iGs][iAs][iTs][iAs][iAs][iGs][iAs][iGs][iTs][iTs][i$^{5}$C] | 913 |
| 360 | CATTTATTCAACGGGATAAGAGTT | 117 | [i$^{5}$Cs][iAs][iTs][iTs][iTs][iAs][iTs][iTs][i$^{5}$Cs][iAs][iAs][i$^{5}$Cs][iGs][iGs][iGs][iAs][iTs][iAs][iAs][iGs][iAs][iGs][iTs][iT] | 914 |
| 361 | CATTTATTCAACGGGGATAAGAGTT | 339 | [i$^{5}$Cs][iAs][iTs][iTs][iTs][iAs][iTs][iTs][i$^{5}$Cs][iAs][iAs][i$^{5}$Cs][iGs][iGs][iGs][iGs][iAs][iTs][iAs][iAs][iGs][iAs][iGs][iTs][iT] | 915 |
| 362 | GCATTTATTCAAGGGGATAAGAGTT | 340 | [iGs][i$^{5}$Cs][iAs][iTs][iTs][iTs][iAs][iTs][iTs][i$^{5}$Cs][iAs][iAs][iGs][iGs][iGs][iGs][iAs][iTs][iAs][iAs][iGs][iAs][iGs][iTs][iT] | 916 |
| 363 | GCATTTATTCAACGGGATAAGAGTT | 341 | [iGs][i$^{5}$Cs][iAs][iTs][iTs][iTs][iAs][iTs][iTs][i$^{5}$Cs][iAs][iAs][i$^{5}$Cs][iGs][iGs][iGs][iAs][iTs][iAs][iAs][iGs][iAs][iGs][iTs][iT] | 917 |
| 364 | GCATTTATTCAACGGGGATAAGAGT | 342 | [iGs][i$^{5}$Cs][iAs][iTs][iTs][iTs][iAs][iTs][iTs][i$^{5}$Cs][iAs][iAs][i$^{5}$Cs][iGs][iGs][iGs][iGs][iAs][iTs][iAs][iAs][iGs][iAs][iGs][iT] | 918 |
| 365 | TGTTCAATCATTCGGGATAAGAGTTC | 9 | [iTs][iG][iT][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iGs][iTs][iTs][i$^{5}$C] | 919 |
| 366 | TGTTCAATCATTCGGGATAAGAGTTC | 9 | [iTs][iGs][iTs][iTs][i$^{5}$Cs][iAs][iAs][iTs][i$^{5}$Cs][iAs][iT][iT][i$^{5}$Cs][iGs][iGs][iGs][iAs][iTs][iAs][iAs][iGs][iAs][iGs][iTs][iTs][i$^{5}$C] | 920 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 367 | TGTTCAATCATTCGGGATAAGAGTTC | 9 | [iTs][iGs][iTs][iTs][i$^{5}$Cs][iAs][iAs][iTs][i$^{5}$Cs][iAs][iTs][iTs][i$^{5}$Cs][iGs][iG][iG][iAs][iTs][iAs][iAs][iGs][iAs][iGs][iTs][iTs][i$^{5}$C] | 921 |
| 368 | TGTTCAATCATTCGGGATAAGAGTTC | 9 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iG][iT][iTs][i$^{5}$C] | 922 |
| 369 | TGTTCAATCATTCGGGATAAGAGTTC | 9 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iA][iG][iA][iG][iT][iTs][i$^{5}$C] | 923 |
| 370 | TGTTCAATCATTGGGATAAGAGTTC | 343 | [iTs][iGs][iTs][iTs][i$^{5}$Cs][iAs][iAs][iTs][i$^{5}$Cs][iAs][iTs][iTs][iGs][iGs][iGs][iAs][iTs][iAs][iAs][iGs][iAs][iGs][iTs][iTs][i$^{5}$C] | 924 |
| 371 | TGTTCAATCATTCGGGATAAGAGTT | 344 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iAs][iGs][iTs][lT] | 925 |
| 372 | TGTTCAATCATTCGGGATAAGAGTTC | 9 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iG][iA][iG][iT][iTs][i$^{5}$C] | 569 |
| 373 | TGTTCAATCATTCGGGATAAGAGTTC | 9 | [iTs][iGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iAs][iGs][iA][iG][iT][iTs][i$^{5}$C] | 570 |
| 374 | TGTTCAATCATTCGGGATAAGAGTTC | 9 | [lTs][lGs][iTs][iTs][i$^{5}$Cs][iAs][iAs][iTs][i$^{5}$Cs][iAs][iTs][iTs][i$^{5}$Cs][iGs][iGs][iGs][iAs][iTs][iAs][iA][iG][iA][iG][iT][iTs][i$^{5}$C] | 927 |
| 375 | TGTTCAATCATTCGGGATAAGAGTTC | 9 | [iTs][iGs][lTs][lTs][i$^{5}$Cs][iAs][iAs][iTs][i$^{5}$Cs][iAs][iTs][iTs][i$^{5}$Cs][iGs][iGs][iGs][iAs][iTs][iAs][iA][iG][iA][iG][iT][iTs][i$^{5}$C] | 928 |
| 376 | TGTTCAATCATTCGGGATAAGAGTTC | 9 | [iTs][iGs][iTs][iTs][i$^{5}$Cs][lAs][iAs][iTs][i$^{5}$Cs][iAs][iTs][iTs][i$^{5}$Cs][iGs][iGs][iGs][iAs][iTs][iAs][iA][iG][iA][iG][iT][iTs][i$^{5}$C] | 929 |
| 377 | TGTTCAATCATTCGGGATAAGAGTTC | 9 | [iTs][iGs][iTs][iTs][i$^{5}$Cs][iAs][lAs][lTs][i$^{5}$Cs][iAs][iTs][iTs][i$^{5}$Cs][iGs][iGs][iGs][iAs][iTs][iAs][iA][iG][iA][iG][lT][iTs][i$^{5}$C] | 930 |
| 378 | TGTTCAATCATTCGGGATAAGAGTTC | 9 | [iTs][iGs][iTs][iTs][i$^{5}$Cs][iAs][iAs][iTs][i$^{5}$Cs][lAs][iTs][iTs][i$^{5}$Cs][iGs][iGs][iGs][iAs][iTs][iAs][iA][iG][iA][iG][iT][iTs][i$^{5}$C] | 931 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 379 | TGTTCAATCATTCGGGATAAGAGTTC | 9 | [iTs][iGs][iTs][iTs][i$^5$Cs][iAs][iAs][iTs][i$^5$Cs][iAs][lTs][lTs][i$^5$Cs][iGs][iGs][iGs][iAs][iTs][iAs][iA][iG][iA][iG][iT][iTs][i$^5$C] | 932 |
| 380 | TGTTCAATCATTCGGGATAAGAGTTC | 9 | [iTs][iGs][iTs][iTs][i$^5$Cs][iAs][iAs][iTs][i$^5$Cs][iAs][iTs][iTs][l$^5$Cs][lGs][iGs][iGs][iAs][iTs][iAs][iA][iG][iA][iG][iT][iTs][i$^5$C] | 933 |
| 381 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][lGs][lGs][iAs][iTs][iAs][iA][iG][iA][iG][iT][iTs][i$^5$C] | 934 |
| 382 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][lAs][lTs][iAs][iA][iG][iA][iG][lT][iTs][i$^5$C] | 935 |
| 383 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iA][lG][lA][iG][lT][iTs][i$^5$C] | 936 |
| 384 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iA][lG][lA][iG][iT][iTs][i$^5$C] | 937 |
| 385 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iA][iG][iA][lG][lT][iTs][i$^5$C] | 938 |
| 386 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iA][iG][iA][iG][iT][lTs][l$^5$C] | 939 |
| 387 | TGTTCAATCATTCGGGATAAGAGTTC | 9 | [iTs][iGs][lTs][lTs][i$^5$Cs][iAs][iAs][iTs][i$^5$Cs][iAs][lTs][lTs][i$^5$Cs][iGs][iGs][iGs][iAs][iTs][iAs][iA][iG][iA][iG][iT][iTs][i$^5$C] | 940 |
| 388 | TGTTCAATCATTCGGGATAAGAGTTC | 9 | [iTs][iGs][iTs][iTs][i$^5$Cs][lAs][lAs][iTs][i$^5$Cs][iAs][iTs][iTs][i$^5$Cs][iGs][iGs][iGs][iAs][iTs][iAs][iA][iG][iA][iG][iT][iTs][i$^5$C] | 941 |
| 389 | TGTTCAATCATTCGGGATAAGAGTTC | 9 | [iTs][iGs][iTs][iTs][i$^5$Cs][lAs][lAs][iTs][i$^5$Cs][iAs][iTs][iTs][i$^5$Cs][iGs][iGs][iGs][iAs][iTs][iAs][iA][iG][iA][iG][iT][iTs][i$^5$C] | 942 |
| 390 | TGTTCAATCATTCGGGATAAGAGTTC | 9 | [iTs][iGs][iTs][iTs][i$^5$Cs][iAs][iAs][iTs][i$^5$Cs][iAs][iTs][iTs][i$^5$Cs][iG][iG][iG][iAs][iTs][iAs][iA][iG][iA][iG][iT][iTs][i$^5$C] | 943 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 391 | TGTTCAATCATTCGGGATAAGAGTTC | 9 | [iTs][iGs][iTs][iTs][i$^5$Cs][iAs][iAs][iTs][i$^5$Cs][iAs][iT][iT][i$^5$Cs][iGs][iG][iG][iAs][iTs][iAs][iAs][iGs][iAs][iGs][iTs][iTs][i$^5$C] | 944 |
| 392 | TGTTCAATCATTCGGGATAAGAGTTC | 9 | [iTs][iG][iT][iTs][i$^5$Cs][iAs][iAs][iTs][i$^5$Cs][iAs][iT][iT][i$^5$Cs][iGs][iGs][iGs][iAs][iTs][iAs][iAs][iGs][iAs][iGs][iTs][iTs][i$^5$C] | 945 |
| 393 | TGTTCAATCATTCGGGATAAGAGTTC | 9 | [iTs][iG][iT][iTs][i$^5$Cs][iAs][iAs][iTs][i$^5$Cs][iAs][iTs][iTs][i$^5$Cs][iGs][iG][iG][iAs][iTs][iAs][iAs][iGs][iAs][iGs][iTs][iTs][i$^5$C] | 946 |
| 394 | TGTTCAATCATTCGGGATAAGAGTTC | 9 | [iTs][iG][iT][iTs][i$^5$Cs][iAs][iAs][iTs][i$^5$Cs][iAs][iTs][iTs][i$^5$Cs][iGs][iGs][iGs][iAs][iTs][iAs][iAs][iGs][iAs][iG][iT][iTs][i$^5$C] | 572 |
| 395 | TGTTCAATCATTCGGGATAAGAGTTC | 9 | [iTs][iG][iT][iT][i$^5$Cs][iAs][iAs][iTs][i$^5$Cs][iAs][iTs][iTs][i$^5$Cs][iGs][iGs][iGs][iAs][iTs][iAs][iAs][iGs][iA][iG][iT][iTs][i$^5$C] | 573 |
| 396 | TGTTCAATCATTCGGGATAAGAGTTC | 345 | [x][dt][dc][da][iTs][iGs][iTs][iTs][i$^5$Cs][iAs][iAs][iTs][i$^5$Cs][iAs][iTs][iTs][i$^5$Cs][iGs][iGs][iGs][iAs][iTs][iAs][iA][iG][iA][iG][iT][iTs][i$^5$C] | 947 |
| 397 | TGTTCAATCATTCGGGATAAGAGTTC | 9 | [iTs][iG][iT][iT][i$^5$Cs][iAs][iAs][iTs][i$^5$Cs][iAs][iTs][iTs][i$^5$Cs][iGs][iGs][iGs][iAs][iTs][iAs][iAs][iGs][iAs][iGs][iTs][iTs][i$^5$C] | 948 |
| 398 | TGTTCAATCATTCGGGATAAGAGTTC | 9 | [iTs][iGs][iTs][iT][i$^5$C][iA][iAs][iTs][i$^5$Cs][iAs][iTs][iTs][i$^5$Cs][iGs][iGs][iGs][iAs][iTs][iAs][iAs][iGs][iAs][iGs][iTs][iTs][i$^5$C] | 949 |
| 399 | TGTTCAATCATTCGGGATAAGAGTTC | 9 | [iTs][iGs][iTs][iTs][i$^5$Cs][iA][iA][iT][i$^5$Cs][iAs][iTs][iTs][i$^5$Cs][iGs][iGs][iGs][iAs][iTs][iAs][iAs][iGs][iAs][iGs][iTs][iTs][i$^5$C] | 950 |
| 400 | TGTTCAATCATTCGGGATAAGAGTTC | 9 | [iTs][iGs][iTs][iTs][i$^5$Cs][iAs][iAs][iT][i$^5$C][iA][iTs][iTs][i$^5$Cs][iGs][iGs][iGs][iAs][iTs][iAs][iAs][iGs][iAs][iGs][iTs][iTs][i$^5$C] | 951 |
| 401 | TGTTCAATCATTCGGGATAAGAGTTC | 9 | [iTs][iGs][iTs][iTs][i$^5$Cs][iAs][iAs][iTs][i$^5$Cs][iA][iT][iT][i$^5$Cs][iGs][iGs][iGs][iAs][iTs][iAs][iAs][iGs][iAs][iGs][iTs][iTs][i$^5$C] | 952 |
| 402 | TGTTCAATCATTCGGGATAAGAGTTC | 9 | [iTs][iGs][iTs][iTs][i$^5$Cs][iAs][iAs][iTs][i$^5$Cs][iAs][iTs][iT][i$^5$C][iG][iGs][iGs][iAs][iTs][iAs][iAs][iGs][iAs][iGs][iTs][iTs][i$^5$C] | 953 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 403 | TGTTCAATCATTCGGGATAAGAGTTC | 9 | [iTs][iGs][iTs][iTs][i5Cs][iAs][iAs][iTs][i5Cs][iAs][iTs][iTs][i5Cs][iG][iG][iG][iAs][iTs][iAs][iAs][iGs][iAs][iGs][iTs][iTs][i5C] | 954 |
| 404 | TGTTCAATCATTCGGGATAAGAGTTC | 9 | [iTs][iGs][iTs][iTs][i5Cs][iAs][iAs][iTs][i5Cs][iAs][iTs][iTs][i5Cs][iGs][iGs][iG][iA][iT][iAs][iAs][iGs][iAs][iGs][iTs][iTs][i5C] | 955 |
| 405 | TGTTCAATCATTCGGGATAAGAGTTC | 9 | [iTs][iGs][iTs][iTs][i5Cs][iAs][iAs][iTs][i5Cs][iAs][iTs][iTs][i5Cs][iGs][iGs][iGs][iAs][iT][iA][iA][iGs][iAs][iGs][iTs][iTs][i5C] | 956 |
| 406 | TGTTCAATCATTCGGGATAAGAGTTC | 9 | [iTs][iGs][iTs][iTs][i5Cs][iAs][iAs][iTs][i5Cs][iAs][iTs][iTs][i5Cs][iGs][iGs][iGs][iAs][iTs][iAs][iA][iG][iA][iGs][iTs][iTs][i5C] | 957 |
| 407 | TGTTCAATCATTC[n3]GGGATAAGAGTTC | 194/253 | [iTs][iGs][iTs][iTs][i5Cs][iAs][iAs][iTs][i5Cs][iAs][iTs][iTs][i5Cs][n3s][iGs][iGs][iGs][iAs][iTs][iAs][iA][iG][iA][iG][iT][iTs][i5C] | 958/959 |
| 408 | TGTTCAATCATTC[n6]GGGATAAGAGTTC | 194/253 | [iTs][iGs][iTs][iTs][i5Cs][iAs][iAs][iTs][i5Cs][iAs][iTs][iTs][i5Cs][n6s][iGs][iGs][iGs][iAs][iTs][iAs][iA][iG][iA][iG][iT][iTs][i5C] | 958/959 |
| 409 | TCTGTTCAATCATTGGGGATAAGAGT | 347 | [iTs][i5Cs][iTs][iGs][iTs][iTs][i5Cs][iAs][iAs][iTs][i5Cs][iAs][iTs][iTs][iGs][iGs][iGs][iGs][iAs][IT][iA][iA][iG][iA][iGs][IT] | 960 |
| 410 | TCTGTTCAATCATGGGGATAAGAGTT | 348 | [iTs][i5Cs][iTs][iGs][iTs][iTs][i5Cs][iAs][iAs][iTs][i5Cs][iAs][iTs][iGs][iGs][iGs][iGs][iAs][iTs][iA][iA][iG][iA][iTs][IT] | 961 |
| 411 | TCTGTTCAATCATGGGATAAGAGTTC | 349 | [iTs][i5Cs][iTs][iGs][iTs][iTs][i5Cs][iAs][iAs][iTs][i5Cs][iAs][iTs][iGs][iGs][iGs][iAs][iTs][iAs][iA][iG][iA][iG][iT][iTs][i5C] | 962 |
| 412 | CTGTTCAATCATTTGGGGATAAGAGT | 350 | [i5Cs][iTs][iGs][iTs][iTs][i5Cs][iAs][iAs][iTs][i5Cs][iAs][iTs][iTs][iTs][iGs][iGs][iGs][iGs][iAs][iT][iA][iA][iG][iA][iGs][iT] | 963 |
| 413 | CTGTTCAATCATTGGGGATAAGAGTT | 351 | [i5Cs][iTs][iGs][iTs][iTs][i5Cs][iAs][iAs][iTs][i5Cs][iAs][iTs][iTs][iGs][iGs][iGs][iGs][iAs][iTs][iA][iA][iG][iA][iG][iTs][lT] | 964 |
| 414 | CTGTTCAATCATTGGGATAAGAGTTC | 352 | [i5Cs][iTs][iGs][iTs][iTs][i5Cs][iAs][iAs][iTs][i5Cs][iAs][iTs][iTs][iGs][iGs][iGs][iAs][iTs][iAs][iA][iG][iA][iG][iT][iTs][i5C] | 965 |

TABLE 11-continued

| ASO # | Nucleobase Sequence (5' → 3') | SEQ ID NO: | Antisense Oligonucleotide Structures (5' → 3') | SEQ ID NO: |
|---|---|---|---|---|
| Exemplary antisense oligonucleotides | | | | |
| 415 | TGTTCAATCATTCTGGGGATAAGAGT | 353 | [iTs][iGs][iTs][iTs][i$^5$Cs][iAs][iAs][iTs][i$^5$Cs][iAs][iTs][iTs][i$^5$Cs][iTs][iGs][iGs][iGs][iGs][iAs][iT][iA][iA][iG][iA][iGs][iT] | 966 |
| 416 | TGTTCAATCATTCGGGGATAAGAGTT | 163 | [iTs][iGs][iTs][iTs][i$^5$Cs][iAs][iAs][iTs][i$^5$Cs][iAs][iTs][iTs][i5Cs][iGs][iGs][iGs][iGs][iAs][iTs][iA][iA][iG][iA][iG][iTs][iT] | 967 |
| 417 | TGTTCAATCATTCGGATAAGAGTTCT | 354 | [iTs][iGs][iTs][iTs][i$^5$Cs][iAs][iAs][iTs][i$^5$Cs][iAs][iTs][iTs][i$^5$Cs][iGs][iGs][iAs][iTs][iAs][iAs][iG][iA][iG][iT][iT][i$^5$Cs][iT] | 968 |
| 418 | TGTTCAATCATTCGGGATAAGAGTTC | 9 | [nmaTs][nmaGs][nmaTs][nmaTs][nma$^5$Cs][nmaAs][nmaAs][nmaTs][nma$^5$Cs][nmaAs][nmaTs][nmaTs][nma$^5$Cs][nmaGs][nmaGs][nmaGs][nmaAs][nmaTs][nmaAs][nmaA][nmaG][nmaA][nmaG][nmaT][nmaTs][nma$^5$C] | 969 |
| 419 | TCCATCCATCCTTGAGTTCTTTCCAG | 355 | [iTs][i$^5$Cs][i$^5$Cs][iAs][iTs][i$^5$Cs][i$^5$Cs][iAs][iTs][i$^5$Cs][i$^5$Cs][iTs][iTs][iGs][iAs][iGs][iTs][iTs][i5Cs][iTs][iTs][iTs][i$^5$Cs][i$^5$Cs][iAs][iG] | 970 |
| 420 | TCCATCCATCCTT[n6]GAGTTCTTTCCAG | 497/249 | [iTs][i$^5$Cs][i$^5$Cs][iAs][iTs][i$^5$Cs][i$^5$Cs][iAs][iTs][i5Cs][i5Cs][iTs][iTs][n6s][iGs][iAs][iGs][iTs][iTs][i$^5$Cs][iTs][iTs][iTs][i$^5$Cs][i$^5$Cs][iAs][iG] | 971/972 |
| 421 | CTCTCCATCCATCTTCTTTCCAGGAA | 357 | [i5Cs][iTs][i$^5$Cs][iTs][i5Cs][i$^5$Cs][iAs][iTs][i5Cs][i$^5$Cs][iAs][iTs][i$^5$Cs][iTs][iTs][i$^5$Cs][iTs][iTs][iTs][i$^5$Cs][i$^5$Cs][iAs][iGs][iGs][iAs][iA] | 973 |
| 422 | TCCATCCATCCTTGAGTTCTTTCCAG | 355 | [iTs][i5Cs][i$^5$Cs][iAs][iTs][i$^5$Cs][i$^5$Cs][iAs][iTs][i$^5$Cs][i$^5$Cs][lTs][lTs][lGs][lAs][iGs][iTs][iTs][i5Cs][iTs][iTs][iTs][i$^5$Cs][i$^5$Cs][iAs][iG] | 974 |
| 423 | CATCCATCTATCCGGGATAAGAGTTC | 159 | [i$^5$Cs][iA][iT][i$^5$Cs][i$^5$Cs][iAs][iTs][i$^5$Cs][iTs][iAs][iTs][i$^5$Cs][i$^5$Cs][iGs][iGs][iGs][iAs][iTs][iAs][iAs][iGs][iAs][iGs][iTs][iTs][i$^5$C] | 975 |
| 424 | CATCCATCTATCCGGGATAAGAGTTC | 159 | [i5Cs][iAs][iTs][i$^5$Cs][i$^5$Cs][iAs][iTs][i$^5$Cs][iTs][iAs][iT][i$^5$C][i$^5$Cs][iGs][iGs][iGs][iAs][iTs][iAs][iAs][iGs][iAs][iGs][iTs][iTs][i$^5$C] | 976 |
| 425 | CATCCATCTATCCGGGATAAGAGTTC | 159 | [i5Cs][iAs][iTs][i$^5$Cs][i$^5$Cs][iAs][iTs][i$^5$Cs][iTs][iAs][iTs][i$^5$Cs][i$^5$Cs][iGs][iG][iG][iAs][iTs][iAs][iAs][iGs][iAs][iGs][iTs][iTs][i$^5$C] | 977 |

TABLE 11-continued

| ASO # | Nucleobase Sequence (5' → 3') | SEQ ID NO: | Antisense Oligonucleotide Structures (5' → 3') | SEQ ID NO: |
|---|---|---|---|---|
| | Exemplary antisense oligonucleotides | | | |
| 426 | CATCCATCTATCCGGGATAAGAGTTC | 159 | [i5Cs][iAs][iTs][i$^5$Cs][i$^5$Cs][iAs][iTs][i$^5$Cs][iTs][iAs][iTs][i$^5$Cs][i$^5$Cs][iGs][iGs][iGs][iAs][iTs][iAs][iAs][iGs][iAs][iG][iT][iTs][i$^5$C] | 978 |
| 427 | CATCCATCTATCCGGGATAAGAGTTC | 159 | [i5Cs][iAs][iTs][i$^5$Cs][i$^5$Cs][iAs][iTs][i$^5$Cs][iTs][iAs][iTs][i$^5$Cs][i$^5$Cs][iGs][iGs][iGs][iAs][iTs][iAs][iA][iG][iA][iG][iT][iTs][i$^5$C] | 979 |
| 428 | ATCCATCTATCCGGGATAAGAGTTC | 358 | [lAs][lTs][i5Cs][i$^5$Cs][iAs][iTs][i$^5$Cs][iTs][iAs][iTs][i$^5$Cs][i$^5$Cs][iGs][iGs][iAs][iTs][iAs][iAs][iGs][iAs][iGs][iTs][iTs][i5C] | 980 |
| 429 | ATCCATCTATCCGGGATAAGAGTT | 359 | [iAs][iTs][i5Cs][i$^5$Cs][iAs][iTs][i$^5$Cs][iTs][iAs][iTs][i$^5$Cs][i5Cs][lGs][iGs][iGs][iAs][iTs][iAs][iAs][iGs][iAs][iGs][lTs][lT] | 981 |
| 430 | ATCCATCTATCCGGGATAAGAGTTC | 358 | [iAs][iTs][i5Cs][i$^5$Cs][iAs][iTs][i$^5$Cs][iTs][iAs][iTs][i$^5$Cs][i$^5$Cs][iGs][iGs][iAs][iTs][iAs][iAs][iGs][iAs][iGs][iTs][iTs][i$^5$C] | 982 |
| 431 | ATCCATCTATCCGGGATAAGAGTT | 359 | [iAs][iTs][i$^5$Cs][i$^5$Cs][iAs][iTs][i$^5$Cs][iTs][iAs][iTs][i$^5$Cs][i$^5$Cs][iGs][iGs][iGs][iAs][iTs][iAs][iAs][iGs][iAs][iGs][iTs][iT] | 983 |
| 432 | CAACTCATCCATCAGAGTTCTTTCCA | 360 | [i5Cs][iAs][iAs][i$^5$Cs][iTs][i$^5$Cs][iAs][iTs][i$^5$Cs][i5Cs][iAs][iTs][i$^5$Cs][iAs][iGs][iAs][iGs][iTs][iTs][i$^5$Cs][iTs][iTs][iTs][i$^5$Cs][i$^5$Cs][iA] | 984 |
| 433 | GCCACGAATCTACGGATAAGAGTTCT | 361 | [iGs][i$^5$Cs][i5Cs][iAs][i$^5$Cs][iGs][iAs][iAs][iTs][i5Cs][iTs][iAs][i$^5$Cs][iGs][iGs][iAs][iTs][iAs][iAs][iGs][iAs][iGs][iTs][iTs][i$^5$Cs][iT] | 985 |
| 434 | CCACGAATCTACCGGGATAAGAGTTC | 14 | [i$^5$Cs][i$^5$C][iA][i$^5$Cs][iGs][iAs][iAs][iTs][i$^5$Cs][iTs][iAs][i5Cs][i$^5$Cs][iGs][iGs][iGs][iAs][iTs][iAs][iAs][iGs][iAs][iGs][iTs][iTs][i$^5$C] | 986 |
| 435 | CCACGAATCTACCGGGATAAGAGTTC | 14 | [i5Cs][i5Cs][iAs][i$^5$Cs][iGs][iAs][iAs][iTs][i$^5$Cs][iTs][iA][i$^5$C][i$^5$Cs][iGs][iGs][iGs][iAs][iTs][iAs][iAs][iGs][iAs][iGs][iTs][iTs][i$^5$C] | 987 |
| 436 | CCACGAATCTACCGGGATAAGAGTTC | 14 | [i5Cs][i5Cs][iAs][i5Cs][iGs][iAs][iAs][iTs][i$^5$Cs][iTs][iAs][i5Cs][i$^5$Cs][iGs][iG][iG][iAs][iTs][iAs][iAs][iGs][iAs][iGs][iTs][iTs][i$^5$C] | 988 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 437 | CCACGAATCTACCGGGATAAGAGTTC | 14 | [i5Cs][i$^5$Cs][iAs][i$^5$Cs][iGs][iAs][iAs][iTs][i$^5$Cs][iTs][iAs][i$^5$Cs][i$^5$Cs][iGs][iGs][iGs][iAs][iTs][iAs][iAs][iGs][iAs][iG][iT][iTs][i$^5$C] | 989 |
| 438 | CCACGAATCTACCGGGATAAGAGTTC | 14 | [i5Cs][i$^5$Cs][iAs][i$^5$Cs][iGs][iAs][iAs][iTs][i$^5$Cs][iTs][iAs][i5Cs][i$^5$Cs][iGs][iGs][iGs][iAs][iTs][iAs][iA][iG][iA][iG][iT][iTs][i$^5$C] | 990 |
| 439 | CCACGAATCTACCGGATAAGAGTTCT | 8 | [i5Cs][i$^5$C][iA][i5Cs][iGs][iAs][iAs][iTs][i$^5$Cs][iTs][iAs][i$^5$Cs][i$^5$Cs][iGs][iGs][iAs][iTs][iAs][iAs][iGs][iAs][iGs][iTs][iTs][i$^5$Cs][iT] | 991 |
| 440 | CCACGAATCTACCGGATAAGAGTTCT | 8 | [i$^5$Cs][i$^5$Cs][iAs][i$^5$Cs][iGs][iAs][iAs][iTs][i$^5$Cs][iTs][iA][i$^5$C][i$^5$Cs][iGs][iGs][iAs][iTs][iAs][iAs][iGs][iAs][iGs][iTs][iTs][i5Cs][iT] | 992 |
| 441 | CCACGAATCTACCGGATAAGAGTTCT | 8 | [i5Cs][i$^5$Cs][iAs][i$^5$Cs][iGs][iAs][iAs][iTs][i$^5$Cs][iTs][iAs][i5Cs][i$^5$Cs][iGs][iG][iA][iTs][iAs][iAs][iGs][iAs][iGs][iTs][iTs][i$^5$Cs][iT] | 993 |
| 442 | CCACGAATCTACCGGATAAGAGTTCT | 8 | [i5Cs][i$^5$Cs][iAs][i$^5$Cs][iGs][iAs][iAs][iTs][i$^5$Cs][iTs][iAs][i5Cs][i$^5$Cs][iGs][iGs][iAs][iTs][iAs][iAs][iGs][iAs][iGs][iT][iT][i$^5$Cs][iT] | 994 |
| 443 | CCACGAATCTACCGGATAAGAGTTCT | 8 | [i5Cs][i$^5$Cs][iAs][i$^5$Cs][iGs][iAs][iAs][iTs][i$^5$Cs][iTs][iAs][i$^5$Cs][i$^5$Cs][iGs][iGs][iAs][iTs][iAs][iAs][iG][iA][iG][iT][iT][i$^5$Cs][iT] | 995 |
| 444 | CACGAATCTACCGATAAGAGTTCT | 362 | [i5Cs][iAs][i$^5$Cs][iGs][iAs][iAs][iTs][i$^5$Cs][iTs][iAs][i5Cs][i5Cs][iGs][iAs][iTs][iAs][iAs][iGs][iAs][iGs][iTs][iTs][i$^5$Cs][iT] | 996 |
| 445 | CCACGAATCTACGATAAGAGTTCT | 363 | [i5Cs][i$^5$Cs][iAs][i$^5$Cs][iGs][iAs][iAs][iTs][i$^5$Cs][iTs][iAs][i$^5$Cs][iGs][iAs][iTs][iAs][iAs][iGs][iAs][iGs][iTs][iTs][i$^5$Cs][iT] | 997 |
| 446 | CACGAATCTACCGGGGATAAGAGT | 364 | [i5Cs][iAs][i$^5$Cs][iGs][iAs][iAs][iTs][i$^5$Cs][iTs][iAs][i$^5$Cs][i$^5$Cs][iGs][iGs][iGs][iGs][iAs][iTs][iAs][iAs][iGs][iAs][iGs][iT] | 998 |
| 447 | CCACGAATCTACGGGGATAAGAGT | 365 | [i5Cs][i$^5$Cs][iAs][i$^5$Cs][iGs][iAs][iAs][iTs][i$^5$Cs][iTs][iAs][i$^5$Cs][iGs][iGs][iGs][iGs][iAs][iTs][iAs][iAs][iGs][iAs][iGs][iT] | 999 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 448 | CACGAATCTACCGGATAAGAGTTC | 366 | [i$^5$Cs][iAs][i$^5$Cs][iGs][iAs][iAs][iTs][i$^5$Cs][iTs][iAs][i$^5$Cs][i$^5$Cs][iGs][iGs][iAs][iTs][iAs][iAs][iGs][iAs][iGs][iTs][iTs][i$^5$C] | 1000 |
| 449 | CACGAATCTACCGGGATAAGAGTT | 367 | [i$^5$Cs][iAs][i$^5$Cs][iGs][iAs][iAs][iTs][i$^5$Cs][iTs][iAs][i$^5$Cs][i$^5$Cs][iGs][iGs][iGs][iAs][iTs][iAs][iAs][iGs][iAs][iGs][iTs][iT] | 1001 |
| 450 | CCACGAATCTACGGATAAGAGTTC | 368 | [i$^5$Cs][i$^5$Cs][iAs][i$^5$Cs][iGs][iAs][iAs][iTs][i$^5$Cs][iTs][iAs][i$^5$Cs][iGs][iGs][iAs][iTs][iAs][iAs][iGs][iAs][iGs][iTs][iTs][i$^5$C] | 1002 |
| 451 | CCACGAATCTACGGGATAAGAGTT | 369 | [i$^5$Cs][i$^5$Cs][iAs][i$^5$Cs][iGs][iAs][iAs][iTs][i$^5$Cs][iTs][iAs][i$^5$Cs][iGs][iGs][iGs][iAs][iTs][iAs][iAs][iGs][iAs][iGs][iTs][iT] | 1003 |
| 452 | CACGAATCTACCGATAAGAGTTCT | 362 | [i$^5$Cs][iAs][i$^5$Cs][iGs][iAs][iAs][iTs][i$^5$Cs][iTs][iAs][i$^5$Cs][i$^5$Cs][iGs][iAs][iTs][iAs][iAs][iGs][iAs][iGs][iTs][iTs][i$^5$Cs][iT] | 1004 |
| 453 | CCACGAATCTACGGGGATAAGAGT | 365 | [i$^5$Cs][i$^5$Cs][iAs][i$^5$Cs][iGs][iAs][iAs][iTs][i$^5$Cs][iTs][iAs][i$^5$Cs][iGs][iGs][iGs][iGs][iAs][iTs][iAs][iAs][iGs][iAs][iGs][iT] | 1005 |
| 454 | CCACGAATCTACCGGGGATAAGAGTT | 22 | [i5Cs][i$^5$C][iA][i5Cs][iGs][iAs][iAs][iTs][i$^5$Cs][iTs][iAs][i5Cs][i$^5$Cs][iGs][iGs][iGs][iGs][iAs][iTs][iAs][iAs][iGs][iAs][iGs][iTs][iT] | 1006 |
| 455 | CCACGAATCTACCGGGGATAAGAGTT | 22 | [i5Cs][i5Cs][iAs][i$^5$Cs][iGs][iAs][iAs][iTs][i$^5$Cs][iTs][iA][i$^5$C][i$^5$Cs][iGs][iGs][iGs][iGs][iAs][iTs][iAs][iAs][iGs][iAs][iGs][iTs][iT] | 1007 |
| 456 | CCACGAATCTACCGGGGATAAGAGTT | 22 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iG][iG][iGs][iAs][iTs][iAs][iAs][iGs][iAs][iGs][iTs][iT] | 1008 |
| 457 | CCACGAATCTACCGGGGATAAGAGTT | 22 | [i5Cs][i$^5$Cs][iAs][i$^5$Cs][iGs][iAs][iAs][iTs][i$^5$Cs][iTs][iAs][i5Cs][i$^5$Cs][iGs][iGs][iGs][iGs][iAs][iTs][iAs][iAs][iGs][iA][iG][iTs][iT] | 1009 |
| 458 | CCACGAATCTACCGGGGATAAGAGTT | 22 | [i5Cs][i$^5$Cs][iAs][i$^5$Cs][iGs][iAs][iAs][iTs][i$^5$Cs][iTs][iAs][i$^5$Cs][i$^5$Cs][iGs][iGs][iGs][iGs][iAs][iT][iA][iA][iG][iA][iG][iTs][iT] | 1010 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 459 | ACGAATCTACCCAGGGGATAAGAGTT | 370 | [iAs][i5Cs][iGs][iAs][iAs][iTs][i$^5$Cs][iTs][iAs][i5Cs][i$^5$Cs][i$^5$Cs][iAs][iGs][iGs][iGs][iGs][iAs][iTs][iAs][iAs][iGs][iAs][iGs][iTs][iT] | 1011 |
| 460 | CTAGCCACGAATCTAAGAGTTCTTTC | 371 | [i5Cs][iTs][iAs][iGs][i$^5$Cs][i$^5$Cs][iAs][i$^5$Cs][iGs][iAs][iAs][iTs][i5Cs][iTs][iAs][iAs][iGs][iAs][iGs][iTs][iTs][i$^5$Cs][iTs][iTs][iTs][i$^5$C] | 1012 |
| 461 | CCACGAATCTACCATAAGAGTTCTTT | 372 | [i5Cs][i$^5$Cs][iAs][i$^5$Cs][iGs][iAs][iAs][iTs][i$^5$Cs][iTs][iAs][i5Cs][i$^5$Cs][iAs][iTs][iAs][iAs][iGs][iAs][iGs][iTs][iTs][i$^5$Cs][iTs][iTs][lT] | 1013 |
| 462 | CCATCCATCATCCGGGATAAGAGTCC | 373 | [i5Cs][i$^5$Cs][iAs][iTs][i5Cs][i$^5$Cs][iAs][iTs][i5Cs][iAs][iT][i5C][i$^5$Cs][iGs][iGs][iGs][iAs][iTs][iAs][iAs][iGs][iAs][iGs][iTs][i$^5$Cs][i$^5$C] | 1014 |
| 463 | TCCATCCATCATCGGGGATAAGAGTT | 120 | [iTs][i$^5$C][i$^5$C][iAs][iTs][i$^5$Cs][i$^5$Cs][iAs][iTs][i5Cs][iAs][iTs][i$^5$Cs][iGs][iGs][iGs][iGs][iAs][iTs][iAs][iAs][iGs][iAs][iGs][iTs][iT] | 1015 |
| 464 | TCCATCCATCATCGGGGATAAGAGTT | 120 | [iTs][i$^5$Cs][i5Cs][iAs][iTs][i$^5$Cs][i$^5$Cs][iAs][iTs][i$^5$Cs][iA][iT][i$^5$Cs][iGs][iGs][iGs][iGs][iAs][iTs][iAs][iAs][iGs][iAs][iGs][iTs][iT] | 1016 |
| 465 | TCCATCCATCATCGGGGATAAGAGTT | 120 | [iTs][i5Cs][i$^5$Cs][iAs][iTs][i$^5$Cs][i$^5$Cs][iAs][iTs][i5Cs][iAs][iTs][i$^5$Cs][iGs][iG][iG][iGs][iAs][iTs][iAs][iAs][iGs][iAs][iGs][iTs][iT] | 1017 |
| 466 | TCCATCCATCATCGGGGATAAGAGTT | 120 | [iTs][i5Cs][i$^5$Cs][iAs][iTs][i$^5$Cs][i$^5$Cs][iAs][iTs][i5Cs][iAs][iTs][i$^5$Cs][iGs][iGs][iGs][iGs][iAs][iTs][iAs][iAs][iGs][iA][iG][iTs][iT] | 1018 |
| 467 | TCCATCCATCATCGGGGATAAGAGTT | 120 | [iTs][i$^5$Cs][i$^5$Cs][iAs][iTs][i$^5$Cs][i$^5$Cs][iAs][iTs][i5Cs][iAs][iTs][i$^5$Cs][iGs][iGs][iGs][iGs][iAs][iTs][iA][iA][iG][iA][iG][iTs][iT] | 1019 |
| 468 | TCCATCCATCATCGGGATAAGAGTTC | 121 | [iTs][i5C][i5C][iAs][iTs][i$^5$Cs][i$^5$Cs][iAs][iTs][i5Cs][iAs][iTs][i$^5$Cs][iGs][iGs][iGs][iAs][iTs][iAs][iAs][iGs][iAs][iGs][iTs][iTs][i$^5$C] | 1020 |
| 469 | TCCATCCATCATCGGGATAAGAGTTC | 121 | [iTs][i5Cs][i$^5$Cs][iAs][iTs][i$^5$Cs][i$^5$Cs][iAs][iTs][i5Cs][iA][iT][i$^5$Cs][iGs][iGs][iGs][iAs][iTs][iAs][iAs][iGs][iAs][iGs][iTs][iTs][i$^5$C] | 1021 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 470 | TCCATCCATCATCGGGATAAGAGTTC | 121 | [iTs][i$^5$Cs][i$^5$Cs][iAs][iTs][i$^5$Cs][i$^5$Cs][iAs][iTs][i5Cs][iAs][iTs][i$^5$Cs][iGs][iG][iG][iAs][iTs][iAs][iAs][iGs][iAs][iGs][iTs][iTs][i$^5$C] | 1022 |
| 471 | TCCATCCATCATCGGGATAAGAGTTC | 121 | [iTs][i$^5$Cs][i$^5$Cs][iAs][iTs][i$^5$Cs][i$^5$Cs][iAs][iTs][i5Cs][iAs][iTs][i$^5$Cs][iGs][iGs][iGs][iAs][iTs][iAs][iAs][iGs][iAs][iG][iT][iTs][i$^5$C] | 1023 |
| 472 | TCCATCCATCATCGGGATAAGAGTTC | 121 | [iTs][i$^5$Cs][i$^5$Cs][iAs][iTs][i$^5$Cs][i$^5$Cs][iAs][iTs][i$^5$Cs][iAs][iTs][i$^5$Cs][iGs][iGs][iGs][iAs][iTs][iAs][iA][iG][iA][iG][iT][iTs][i$^5$C] | 1024 |
| 473 | TCCATCCATCATCGGATAAGAGTTCT | 122 | [iTs][i$^5$Cs][i$^5$Cs][iAs][iTs][i$^5$Cs][i$^5$Cs][iAs][iTs][i$^5$Cs][iAs][iTs][i$^5$Cs][iGs][iGs][iAs][iTs][iAs][iAs][iG][iA][iG][iT][iT][i$^5$Cs][iT] | 1025 |
| 474 | CCATCCATCATCCGATAAGAGTTCTT | 123 | [i$^5$Cs][i$^5$C][iA][iTs][i$^5$Cs][i$^5$Cs][iAs][iTs][i$^5$Cs][iAs][iTs][i$^5$Cs][i$^5$Cs][iGs][iAs][iTs][iAs][iAs][iGs][iAs][iGs][iTs][iTs][i$^5$Cs][iTs][iT] | 1026 |
| 475 | CCATCCATCATCCGATAAGAGTTCTT | 123 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iA][iT][iAs][iAs][iGs][iAs][iGs][iTs][iTs][i$^5$Cs][iTs][iT] | 1027 |
| 476 | CCATCCATCATCCGATAAGAGTTCTT | 123 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iAs][iTs][iAs][iAs][iGs][iAs][iGs][iTs][iT][i$^5$C][iTs][iT] | 1028 |
| 477 | CCATCCATCATCCGATAAGAGTTCTT | 123 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][iGs][iAs][iTs][iAs][iAs][iGs][iA][iG][iT][iT][i$^5$C][iTs][iT] | 1029 |
| 478 | CCATCCATCATCGGGGATAAGAGT | 374 | [i$^5$Cs][i$^5$Cs][iAs][iTs][i$^5$Cs][i$^5$Cs][iAs][iTs][i$^5$Cs][iAs][iTs][i$^5$Cs][iGs][iGs][iGs][iGs][iAs][iTs][iAs][iAs][iGs][iAs][iGs][iT] | 1030 |
| 479 | CCATCCATCATCGGGGATAAGAGT | 374 | [l$^5$Cs][l$^5$Cs][iAs][iTs][i$^5$Cs][i$^5$Cs][iAs][iTs][l$^5$Cs][iAs][iTs][l$^5$Cs][lGs][iGs][iGs][iGs][iAs][iTs][iAs][iAs][iGs][iAs][lGs][lT] | 1031 |
| 480 | CCATCCATCATCGGATAAGAGTTC | 48 | [l$^5$Cs][l$^5$Cs][iAs][iTs][i$^5$Cs][i$^5$Cs][iAs][iTs][l$^5$Cs][iAs][iTs][l$^5$Cs][lGs][iGs][iAs][iTs][iAs][iAs][iGs][iAs][iGs][iTs][lTs][l$^5$C] | 1032 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 481 | TCATCCATCTAGCGGGATAAGAGTTC | 375 | [iTs][i5Cs][iAs][iTs][i5Cs][i5Cs][iAs][iTs][i5Cs][iTs][iAs][iGs][i5Cs][iGs][iGs][iGs][iAs][iTs][iAs][iAs][iGs][iAs][iGs][iTs][iTs][i5C] | 1033 |
| 482 | CATCCATCTAGCCGGGATAAGAGTTC | 376 | [i5Cs][iAs][iTs][i5Cs][i5Cs][iAs][iTs][i5Cs][iTs][iAs][iGs][i5Cs][i5Cs][iGs][iGs][iGs][iAs][iTs][iAs][iAs][iGs][iAs][iGs][iTs][iTs][i5C] | 1034 |
| 483 | TCCATCTAGCCACGGGGATAAGAGTT | 377 | [iTs][i5Cs][i5Cs][iAs][iTs][i5Cs][iTs][iAs][iGs][i5Cs][i5Cs][iAs][i5Cs][iGs][iGs][iGs][iGs][iAs][iTs][iAs][iAs][iGs][iAs][iGs][iTs][iT] | 1035 |
| 484 | ATCCATCTAGCCGGGATAAGAGTT | 378 | [iAs][iTs][i5Cs][i5Cs][iAs][iTs][i5Cs][iTs][iAs][iGs][i5Cs][i5Cs][iGs][iGs][iGs][iAs][iTs][iAs][iAs][iGs][iAs][iGs][iTs][iT] | 1036 |
| 485 | ATCCATCTAGCCGGGGATAAGAGT | 379 | [iAs][iTs][i5Cs][i5Cs][iAs][iTs][i5Cs][iTs][iAs][iGs][i5Cs][i5Cs][iGs][iGs][iGs][iGs][iAs][iTs][iAs][iAs][iGs][iAs][iGs][iT] | 1037 |
| 486 | CCATCCATCATCCGGGGATAAGAGTT | 380 | [i5Cs][i5Cs][iAs][iTs][i5Cs][i5Cs][iAs][iTs][i5Cs][iAs][iTs][i5Cs][i5Cs][iGs][iGs][iGs][iGs][iAs][iTs][iAs][iAs][iGs][iAs][iGs][iTs][iT] | 1038 |
| 487 | ATATATCCATCCACTAGTTCCTGGGG | 381 | [iAs][iTs][iAs][iTs][iAs][iTs][i5Cs][i5Cs][iAs][iTs][i5Cs][i5Cs][iAs][i5Cs][iTs][iAs][iGs][iTs][iTs][i5Cs][i5Cs][iTs][iGs][iGs][iGs][iG] | 1039 |
| 488 | ATATATCCATCCA[n6]CTAGTTCCTGGGG | 506/259 | [iAs][iTs][iAs][iTs][iAs][iTs][i5Cs][i5Cs][iAs][iTs][i5Cs][i5Cs][iAs][n6s][i5Cs][iTs][iAs][iGs][iTs][iTs][i5Cs][i5Cs][iTs][iGs][iGs][iGs][iG] | 1040/1041 |
| 489 | ATATATCCATCCACTAGTTCCTGGGG | 381 | [iAs][iTs][iAs][iTs][iAs][iTs][i5Cs][i5Cs][iAs][iTs][i5Cs][i5Cs][iAs][i5Cs][iTs][iAs][iGs][iTs][iTs][i5Cs][i5Cs][iTs][iGs][iGs][iGs][iG] | 1042 |
| 490 | TAGTTCAATCATAAGAGTTCTTTCCA | 383 | [iTs][iAs][iGs][iTs][iTs][i5Cs][iAs][iAs][iTs][i5Cs][iAs][iTs][iAs][iAs][iGs][iAs][iGs][iTs][iTs][i5Cs][iTs][iTs][iTs][i5Cs][i5Cs][iA] | 1043 |
| 491 | TCATCTGTTCAACAAACTAG | 384 | [iTs][i5Cs][iAs][iTs][i5Cs][iTs][iGs][iTs][iTs][i5Cs][iAs][iAs][i5Cs][iAs][iAs][iAs][i5Cs][iTs][iAs][iG] | 1044 |
| 492 | ATCTGTTCAATCAGCATTTATTCAAC | 385 | [iAs][iTs][i5Cs][iTs][iGs][iTs][iTs][i5Cs][iAs][iAs] | 1045 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| | | | [iTs][i$^5$Cs][iAs][iGs][i$^5$Cs][iAs][iTs][iTs][iTs][iAs][iTs][iTs][i$^5$Cs][iAs][iAs][i$^5$C] | |
| 493 | ATCTACCCACCAGCATTTAT | 386 | [iAs][iTs][i$^5$Cs][iTs][iAs][i$^5$Cs][i$^5$Cs][i$^5$Cs][iAs][i$^5$Cs][i$^5$Cs][iAs][iGs][i$^5$Cs][iAs][iTs][iTs][iTs][iAs][iT] | 1046 |
| 494 | CCACGAATCTACCGTTCAATCATTCA | 387 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iTs][iTs][i$^5$Cs][iAs][iAs][iTs][i$^5$Cs][iAs][iTs][iTs][i$^5$Cs][iA] | 1047 |
| 495 | CACGAATCTACCCATTCACCAGCATT | 388 | [i$^5$Cs][iAs][i$^5$Cs][iGs][iAs][iAs][iTs][i$^5$Cs][iTs][iAs][i$^5$Cs][i$^5$Cs][i$^5$Cs][iAs][iTs][iTs][i$^5$Cs][iAs][i$^5$Cs][i$^5$Cs][iAs][iGs][i$^5$Cs][iAs][iTs][iT] | 1048 |
| 496 | ACGAATCTACCCAGTTCAATCATTCA | 389 | [iAs][i$^5$Cs][iGs][iAs][iAs][iTs][i$^5$Cs][iTs][iAs][i$^5$Cs][i$^5$Cs][i$^5$Cs][iAs][iGs][iTs][iTs][i$^5$Cs][iAs][iAs][iTs][i$^5$Cs][iAs][iTs][iTs][i$^5$Cs][iA] | 1049 |
| 497 | CCACGAATCTACCGTTCAATCATTCA | 387 | [i$^5$Cs][i$^5$C][iA][i$^5$C][iGs][iAs][iAs][iTs][i$^5$Cs][iTs][iAs][i$^5$Cs][i$^5$Cs][iGs][iTs][iTs][i$^5$Cs][iAs][iAs][iTs][i$^5$Cs][iAs][iTs][iTs][i$^5$Cs][iA] | 1050 |
| 498 | CCACGAATCTACCGTTCAATCATTCA | 387 | [i$^5$Cs][i$^5$Cs][iAs][i$^5$Cs][iGs][iAs][iAs][iTs][i$^5$Cs][iTs][iAs][i$^5$Cs][i$^5$Cs][iGs][iTs][iTs][i$^5$Cs][iAs][iAs][iTs][i$^5$Cs][iA][iT][iT][i$^5$Cs][iA] | 1051 |
| 499 | CACGAATCTACCCATTCACCAGCATT | 388 | [i$^5$Cs][iA][i$^5$C][iG][iAs][iAs][iTs][i$^5$Cs][iTs][iAs][i$^5$Cs][i$^5$Cs][i$^5$Cs][iAs][iTs][iTs][i$^5$Cs][iAs][i$^5$Cs][i$^5$Cs][iAs][iGs][i$^5$Cs][iAs][iTs][iT] | 1052 |
| 500 | CACGAATCTACCCATTCACCAGCATT | 388 | [i$^5$Cs][iAs][i$^5$Cs][iGs][iAs][iAs][iTs][i$^5$Cs][iTs][iAs][i$^5$Cs][i$^5$Cs][i$^5$Cs][iAs][iTs][iTs][i$^5$Cs][iAs][i$^5$Cs][i$^5$Cs][iAs][iG][i$^5$C][iA][iTs][iT] | 1053 |
| 501 | CCATCCATGTACTCAATCAT | 390 | [l$^5$Cs][i$^5$Cs][iAs][iTs][i$^5$Cs][i$^5$Cs][iAs][iTs][iGs][iTs][iAs][i$^5$Cs][iTs][i$^5$Cs][iAs][iAs][iTs][i$^5$Cs][iAs][lT] | 1054 |
| 502 | GAATCTACCCATCTGTTCAATC | 106 | [zGs][zAs][iAs][iTs][i$^5$Cs][iTs][iAs][i$^5$Cs][i$^5$Cs][z$^5$Cs][zAs][zTs][z$^5$Cs][iTs][iGs][iTs][iTs][i$^5$Cs][iAs][iAs][zTs][l$^5$C] | 1055 |
| 503 | CGAATCTACCCAATCTGTTCAATC | 36 | [z$^5$Cs][zGs][zAs][zAs][iTs][i$^5$Cs][iTs][iAs][i$^5$Cs][i$^5$Cs][z$^5$Cs][zAs][zAs][zTs][i$^5$ | 1056 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| | | | Cs][iTs][iGs][iTs][iTs][i$^5$Cs][zAs][zAs][zTs][l$^5$C] | |
| 504 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][lA] | 1057 |
| 505 | CGAATCTACCCACATCTGTTCAATCA | 2 | [i$^5$Cs][iG][iA][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] | 1058 |
| 506 | ACGAATCTACCCACATCTGTTCAATC | 93 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iT][iT][i$^5$C][iA][iA][iTs][i$^5$C] | 1059 |
| 507 | CGAATCTACCCACATCTGTTCAAT | 111 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iT] | 1060 |
| 508 | ACGAATCTACCCATCTGTTCAATC | 113 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][iTs][iGs][iTs][iTs][i$^5$Cs][iAs][iAs][iTs][i$^5$C] | 1061 |
| 509 | ACGAATCTACCCACATCTGTTCAATC | 93 | [iAs][i$^5$C][iG][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$C] | 1062 |
| 510 | ACGAATCTACCCACATCTGTTCAATC | 93 | [iAs][i$^5$Cs][iGs][iAs][iAs][iTs][i$^5$Cs][iTs][iAs][i$^5$Cs][i$^5$C][i$^5$C][iAs][i$^5$Cs][iAs][iTs][i$^5$Cs][iTs][iGs][iTs][iTs][i$^5$Cs][iAs][iAs][iTs][i$^5$C] | 1063 |
| 511 | ACGAATCTACCCACATCTGTTCAATC | 93 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iA][iT][i$^5$Cs][iTs][iGs][iTs][iTs][i$^5$Cs][iAs][iAs][iTs][i$^5$C] | 1064 |
| 512 | ACGAATCTACCCACATCTGTTCAATC | 93 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iA][iA][iTs][i$^5$C] | 1065 |
| 513 | CGAATCTACCCAATCTGTTCAATC | 36 | [l$^5$Cs][lG][iA][iAs][iTs][i$^5$Cs][iTs][iAs][i$^5$Cs][i$^5$Cs][i$^5$Cs][lAs][lAs][iTs][i$^5$Cs][iTs][iGs][iTs][iTs][i$^5$Cs][iAs][iAs][lTs][l$^5$C] | 1066 |
| 514 | CGAATCTACCCAATCTGTTCAATC | 36 | [l$^5$Cs][lGs][iAs][iAs][iTs][i$^5$Cs][iTs][iAs][i$^5$Cs][i$^5$C][i$^5$C][lAs][lAs][iTs][i$^5$Cs][iTs][iGs][iTs][iTs][i$^5$Cs][iAs][iAs][lTs][l$^5$C] | 1067 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 515 | CGAATCTACCCAATCTGTTCAATC | 36 | [l$^{5}$Cs][lGs][iAs][iAs][iTs][i$^{5}$Cs][iTs][iAs][i$^{5}$Cs][i$^{5}$Cs][i$^{5}$Cs][lAs][lAs][iT][i$^{5}$C][iTs][iGs][iTs][iTs][i$^{5}$Cs][iAs][iAs][lTs][l$^{5}$C] | 1068 |
| 516 | CGAATCTACCCAATCTGTTCAATC | 36 | [l$^{5}$Cs][lGs][iAs][iAs][iTs][i$^{5}$Cs][iTs][iAs][i$^{5}$Cs][i$^{5}$Cs][i$^{5}$Cs][lAs][lAs][iTs][i$^{5}$Cs][iTs][iGs][iTs][iTs][i$^{5}$Cs][iA][iA][lTs][l$^{5}$C] | 1069 |
| 517 | CGAATCTACCCACCTGTTCAATCA | 391 | [l$^{5}$Cs][lGs][iAs][iAs][iTs][l$^{5}$Cs][iTs][iAs][i$^{5}$Cs][l$^{5}$Cs][i$^{5}$Cs][iAs][l$^{5}$Cs][l$^{5}$Cs][iTs][iGs][iTs][iTs][i$^{5}$Cs][iAs][iAs][iTs][l$^{5}$Cs][lA] | 1070 |
| 518 | CGAATCTACCCACATCTGTTCAAT | 111 | [l$^{5}$Cs][lGs][iAs][iAs][iTs][i$^{5}$Cs][iTs][iAs][i$^{5}$Cs][i$^{5}$Cs][i$^{5}$Cs][iAs][l$^{5}$Cs][lAs][iTs][i$^{5}$Cs][iTs][iGs][iTs][iTs][i$^{5}$Cs][iAs][lAs][lT] | 1071 |
| 519 | CGAATCTACCCACTCTGTTCAATC | 392 | [l$^{5}$Cs][lGs][iAs][iAs][iTs][i$^{5}$Cs][iTs][iAs][i$^{5}$Cs][i$^{5}$Cs][i$^{5}$Cs][iAs][l$^{5}$Cs][lTs][i$^{5}$Cs][iTs][iGs][iTs][iTs][i$^{5}$Cs][iAs][iAs][lTs][l$^{5}$C] | 1072 |
| 520 | CGAATCTACCCAATCTGTTCAATCA | 393 | [i$^{5}$Cs][iGs][iAs][iAs][iTs][i$^{5}$Cs][iTs][iAs][i$^{5}$Cs][i$^{5}$Cs][i$^{5}$Cs][iAs][iAs][iTs][i$^{5}$Cs][iTs][iGs][iTs][iTs][i$^{5}$Cs][iAs][iAs][iTs][i$^{5}$Cs][iA] | 1073 |
| 521 | CGAATCTACCCACTCTGTTCAATCA | 394 | [i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][iTs][i$^{5}$Cs][iTs][iGs][iTs][iTs][i$^{5}$Cs][iAs][iAs][iTs][i$^{5}$Cs][iA] | 1074 |
| 522 | ACGAATCTACCCCATCTGTTCAATC | 395 | [iAs][i$^{5}$Cs][iGs][iAs][iAs][iTs][i$^{5}$Cs][iTs][iAs][i$^{5}$Cs][i$^{5}$Cs][i$^{5}$Cs][i$^{5}$Cs][iAs][iTs][i$^{5}$Cs][iTs][iGs][iTs][iTs][i$^{5}$Cs][iAs][iAs][iTs][i$^{5}$C] | 1075 |
| 523 | ACGAATCTACCCAATCTGTTCAATC | 396 | [iAs][i$^{5}$Cs][iGs][iAs][iAs][iTs][i$^{5}$Cs][iTs][iAs][i$^{5}$Cs][i$^{5}$Cs][i$^{5}$Cs][iAs][iAs][iTs][i$^{5}$Cs][iTs][iGs][iTs][iTs][i$^{5}$Cs][iAs][iAs][iTs][i$^{5}$C] | 1076 |
| 524 | CACGAATCTACCCTGTTCAATCATTC | 397 | [i$^{5}$Cs][iAs][i$^{5}$Cs][iGs][iAs][iAs][iTs][i$^{5}$Cs][iTsCs][iAs][iAs][iTs][i$^{5}$Cs][iAs][iTs][iTs][i$^{5}$C] | 1077 |
| 525 | ACGAATCTACCCATGTTCAATCATTC | 398 | [iAs][i$^{5}$Cs][iGs][iAs][iAs][iTs][i$^{5}$Cs][iTs][iAs][i$^{5}$Cs][i$^{5}$Cs][i$^{5}$Cs][iAs][iTs][iGs][iTs][iTs][i$^{5}$Cs][iAs][iAs][iTs][i$^{5}$Cs][iAs][iTs][iTs][i$^{5}$C] | 1078 |
| 526 | CCACGAATCTACCCTGTTCAATCATT | 399 | [i$^{5}$Cs][i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iTs][iGs][iTs][iTs][i$^{5}$Cs][ | 1079 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| | | | iAs][iAs][iTs][i$^{5}$Cs][iAs][iTs][iT] | |
| 527 | ACGAATCTACCCACTGTTCAATCATT | 400 | [iAs][i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][iTs][iGs][iTs][iTs][i$^{5}$Cs][iAs][iAs][iTs][i$^{5}$Cs][iAs][iTs][iT] | 1080 |
| 528 | CCACGAATCTACCCATCTGTTCAATC | 401 | [i$^{5}$Cs][i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iAs][iTs][i$^{5}$Cs][iTs][iGs][iTs][iTs][i$^{5}$Cs][iAs][iAs][iTs][i$^{5}$C] | 1081 |
| 529 | CGAATCTACCCAATCTGTTCAATC | 36 | [i$^{5}$Cs][iGs][iAs][iAs][iTs][i$^{5}$Cs][iTs][iAs][i$^{5}$C][i$^{5}$C][i$^{5}$Cs][iAs][iAs][iTs][i$^{5}$Cs][iTs][iGs][iTs][iTs][i$^{5}$Cs][iAs][iAs][iTs][i$^{5}$C] | 1082 |
| 530 | CGAATCTACCCAATCTGTTCAATC | 36 | [l$^{5}$Cs][lGs][lAs][lAs][iTs][i$^{5}$Cs][iTs][iAs][i$^{5}$Cs][i$^{5}$Cs][l$^{5}$C][lA][lAs][lTs][i$^{5}$Cs][iTs][iGs][iTs][iTs][i$^{5}$Cs][lAs][lAs][lTs][l$^{5}$C] | 1083 |
| 531 | CGAATCTACCCAATCTGTTCAATC | 36 | [l$^{5}$Cs][lGs][lAs][lAs][iTs][i$^{5}$Cs][iTs][iAs][i$^{5}$C][l$^{5}$C][l$^{5}$C][lAs][lAs][lTs][i$^{5}$Cs][iTs][iGs][iTs][iTs][i$^{5}$Cs][lAs][lAs][lTs][l$^{5}$C] | 1084 |
| 532 | CGAATCTACCCAATCTGTTCAATC | 36 | [l$^{5}$Cs][lGs][lAs][lAs][iTs][i$^{5}$Cs][iTs][iAs][l$^{5}$Cs][l$^{5}$C][l$^{5}$C][lA][lAs][lTs][i$^{5}$Cs][iTs][iGs][iTs][iTs][i$^{5}$Cs][lAs][lAs][lTs][l$^{5}$C] | 1085 |
| 533 | CGAATCTACCCAATCTGTTCAATC | 36 | [l$^{5}$Cs][lGs][iAs][iAs][iTs][i$^{5}$Cs][iTs][iAs][l$^{5}$Cs][i$^{5}$C][l$^{5}$C][lAs][lAs][lTs][i$^{5}$Cs][iTs][iGs][iTs][iTs][i$^{5}$Cs][lAs][lAs][lTs][l$^{5}$C] | 1086 |
| 534 | CGAATCTACCCAATCTGTTCAATC | 36 | [l$^{5}$Cs][lGs][lAs][lAs][iTs][l$^{5}$Cs][iTs][iAs][l$^{5}$Cs][i$^{5}$C][l$^{5}$C][lAs][lAs][lTs][i$^{5}$Cs][iTs][iGs][iTs][iTs][l$^{5}$Cs][iAs][iAs][lTs][l$^{5}$C] | 1087 |
| 535 | CGAATCTACCCAATCTGTTCAATC | 36 | [l$^{5}$Cs][lGs][lAs][lAs][iTs][i$^{5}$Cs][iTs][iAs][i$^{5}$Cs][l$^{5}$C][i$^{5}$C][lAs][lAs][iTs][i$^{5}$Cs][iTs][iGs][iTs][iTs][i$^{5}$Cs][lAs][lAs][lTs][l$^{5}$C] | 1088 |
| 536 | CGAATCTACCCAATCTGTTCAATC | 36 | [l$^{5}$Cs][lGs][lAs][iAs][iTs][i$^{5}$Cs][iTs][iAs][i$^{5}$Cs][l$^{5}$C][l$^{5}$C][lAs][lAs][lTs][i$^{5}$Cs][iTs][iGs][iTs][iTs][l$^{5}$Cs][iAs][lAs][lTs][l$^{5}$C] | 1089 |
| 537 | CGAATCTACCCAATCTGTTCAATC | 36 | [l$^{5}$Cs][lGs][lAs][iAs][iTs][i$^{5}$Cs][iTs][iAs][i$^{5}$Cs][i$^{5}$C][i$^{5}$C][lAs][lAs][iTs][i$^{5}$Cs][iTs][iGs][iTs][iTs][i$^{5}$Cs][iAs][lAs][lTs][l$^{5}$C] | 1090 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 538 | CGAATCTACCCAATCTGTTCAATC | 36 | [l$^{5}$Cs][lGs][iAs][lAs][lTs][i$^{5}$Cs][iTs][iAs][l$^{5}$Cs][i$^{5}$C][l$^{5}$C][lAs][lAs][lTs][i$^{5}$Cs][iTs][iGs][iTs][iTs][l$^{5}$Cs][lAs][lAs][lTs][l$^{5}$C] | 1091 |
| 539 | AGCCACGAATCTGTTCAATC | 402 | [lAs][lGs][l$^{5}$Cs][l$^{5}$Cs][iAs][i$^{5}$Cs][iGs][iAs][iAs][iTs][l$^{5}$Cs][iTs][iGs][iTs][iTs][i$^{5}$Cs][iAs][iAs][lTs][l$^{5}$C] | 1092 |
| 540 | CCACCAACTCATTCATCTGT | 403 | [l$^{5}$Cs][l$^{5}$Cs][iAs][i$^{5}$Cs][i$^{5}$Cs][iAs][iAs][i$^{5}$Cs][iTs][i$^{5}$Cs][iAs][iTs][iTs][i$^{5}$Cs][iAs][iTs][i$^{5}$Cs][iTs][lGs][lT] | 1093 |
| 541 | CGAATCTACCCACATCTGTTCAATCA | 2 | [l$^{5}$Cs][lGs][iAs][iAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$Cs][iA][iA][iT][i$^{5}$Cs][iA] | 1094 |
| 542 | CGAATCTACCCACATCTGTTCAATCA | 2 | [l$^{5}$Cs][iGs][lAs][lAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][iTs][iGs][iTs][iTs][i$^{5}$Cs][iA][iA][iT][i$^{5}$Cs][iA] | 1095 |
| 543 | CGAATCTACCCACATCTGTTCAATCA | 2 | [l$^{5}$Cs][iGs][iAs][iAs][lTs][l$^{5}$Cs][iTs][iAs][l$^{5}$Cs][i$^{5}$Cs][l$^{5}$Cs][iAs][i$^{5}$Cs][iAs][iTs][i$^{5}$Cs][iTs][iGs][iTs][iTs][i$^{5}$Cs][iA][iA][iT][i$^{5}$Cs][iA] | 1096 |
| 544 | CGAATCTACCCACATCTGTTCAATCA | 2 | [i$^{5}$Cs][iGs][iAs][iAs][iTs][i$^{5}$Cs][lTs][lAs][i$^{5}$Cs][i$^{5}$Cs][l$^{5}$Cs][iAs][i$^{5}$Cs][iAs][iTs][i$^{5}$Cs][iTs][iGs][iTs][iTs][i$^{5}$Cs][iA][iA][iT][i$^{5}$Cs][iA] | 1097 |
| 545 | CGAATCTACCCACATCTGTTCAATCA | 2 | [i$^{5}$Cs][iGs][iAs][iAs][iTs][i$^{5}$Cs][iTs][iAs][l$^{5}$Cs][l$^{5}$Cs][i$^{5}$Cs][iAs][i$^{5}$Cs][iAs][iTs][i$^{5}$Cs][iTs][iGs][iTs][iTs][i$^{5}$Cs][iA][iA][iT][i$^{5}$Cs][iA] | 1098 |
| 546 | CGAATCTACCCACATCTGTTCAATCA | 2 | [i$^{5}$Cs][iGs][iAs][iAs][iTs][i$^{5}$Cs][iTs][iAs][i$^{5}$Cs][i$^{5}$Cs][l$^{5}$Cs][lAs][i$^{5}$Cs][iAs][iTs][i$^{5}$Cs][iTs][iGs][iTs][iTs][i$^{5}$Cs][iA][iA][iT][i$^{5}$Cs][iA] | 1099 |
| 547 | CGAATCTACCCACATCTGTTCAATCA | 2 | [i$^{5}$Cs][iGs][iAs][iAs][iTs][i$^{5}$Cs][iTs][iAs][i$^{5}$Cs][i$^{5}$Cs][i$^{5}$Cs][iAs][l$^{5}$Cs][lAs][iTs][i$^{5}$Cs][iTs][iGs][iTs][iTs][i$^{5}$Cs][iA][iA][iT][i$^{5}$Cs][iA] | 1100 |
| 548 | CGAATCTACCCACATCTGTTCAATCA | 2 | [i$^{5}$Cs][iGs][iAs][iAs][iTs][i$^{5}$Cs][iTs][iAs]i$^{5}$Cs][i$^{5}$Cs][i$^{5}$Cs][iAs][i$^{5}$Cs][iAs][lTs][l$^{5}$Cs][iTs][iGs][iTs][iTs][i$^{5}$Cs][iA][iA][iT][i$^{5}$Cs][iA] | 1101 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 549 | CGAATCTACCCACATCTGTTCAATCA | 2 | [i$^5$Cs][iGs][iAs][iAs][iTs][i$^5$Cs][iTs][iAs][i$^5$Cs][l$^5$Cs][i$^5$Cs][iAs][i$^5$Cs][iAs][iTs][i$^5$Cs][lTs][lGs][iTs][iTs][i$^5$Cs][iA][iA][iT][i$^5$Cs][iA] | 1102 |
| 550 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][lTs][lTs][i$^5$Cs][iA][iA][iT][i$^5$Cs][iA] | 1103 |
| 551 | CGAATCTACCCACATCTGTTCAATCA | 2 | [i$^5$Cs][iGs][iAs][iAs][iTs][i$^5$Cs][iTs][iAs][l$^5$Cs][i$^5$Cs][i$^5$Cs][iAs][i$^5$Cs][iAs][iTs][i$^5$Cs][iTs][iGs][iTs][iTs][i$^5$Cs][iA][lA][iT][i$^5$Cs][iA] | 1104 |
| 552 | CGAATCTACCCACATCTGTTCAATCA | 2 | [i$^5$Cs][iGs][iAs][iAs][iTs][i$^5$Cs][iTs][iAs][i$^5$Cs][i$^5$Cs][l$^5$Cs][iAs][i$^5$Cs][iAs][iTs][i$^5$Cs][iTs][iGs][iTs][iTs][i$^5$Cs][iA][lA][lT][i$^5$Cs][iA] | 1105 |
| 553 | CGAATCTACCCACATCTGTTCAATCA | 2 | [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iA][iA][iT][l$^5$Cs][lA] | 1106 |
| 554 | CGAATCTACCCACATCTGTTCAATCA | 2 | [i$^5$Cs][iGs][lAs][lAs][iTs][i$^5$Cs][iTs][iAs][l$^5$Cs][l$^5$Cs][i$^5$Cs][iAs][i$^5$Cs][iAs][iTs][i$^5$Cs][iTs][iGs][iTs][iTs][i$^5$Cs][iA][lA][lT][i$^5$Cs][iA] | 1107 |
| 555 | CGAATCTACCCACATCTGTTCAATCA | 2 | [i$^5$Cs][iGs][iAs][iAs][lTs][l$^5$Cs][iTs][iAs][i$^5$Cs][i$^5$Cs][i$^5$Cs][iAs][i$^5$Cs][iAs][iTs][i$^5$Cs][iTs][iGs][iTs][iTs][l$^5$Cs][lA][iA][iT][i$^5$Cs][iA] | 1108 |
| 556 | CGAATCTACCCACATCTGTTCAATCA | 2 | [i$^5$Cs][iGs][iAs][iAs][iTs][i$^5$Cs][iTs][iAs][l$^5$Cs][l$^5$Cs][i$^5$Cs][iAs][i$^5$Cs][iAs][iTs][i$^5$Cs][lTs][lGs][iTs][iTs][i$^5$Cs][iA][iA][iT][i$^5$Cs][iA] | 1109 |
| 557 | CGAATCTACCCACATCTGTTCAATCA | 2 | [i$^5$Cs][iG][iA][iA][iTs][i$^5$Cs][iTs][iAs][i$^5$Cs][i$^5$Cs][i$^5$C][iA][i$^5$C][iAs][iTs][i$^5$Cs][iTs][iGs][iTs][iTs][i$^5$Cs][iAs][iAs][iTs][i$^5$Cs][iA] | 1110 |
| 558 | CGAATCTACCCACATCTGTTCAATCA | 2 | [i$^5$Cs][iG][iA][iA][iTs][i$^5$Cs][iTs][iAs][i$^5$Cs][i$^5$Cs][i$^5$Cs][iAs][i$^5$Cs][iAs][iT][i$^5$C][iT][iGs][iTs][iTs][i$^5$Cs][iAs][iAs][iTs][i$^5$Cs][iA] | 1111 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 559 | CGAATCTACCCACATCTGTTCAATCA | 2 | [i$^5$Cs][iG][iA][iAs][iTs][i$^5$Cs][iTs][iAs][i$^5$Cs][i$^5$Cs][i$^5$C][iA][i$^5$Cs][iAs][iTs][i$^5$Cs][iTs][iGs][iTs][iTs][i$^5$Cs][iAs][iAs][iTs][i$^5$Cs][iA] | 1112 |
| 560 | CGAATCTACCCACATCTGTTCAATCA | 2 | [i$^5$Cs][iG][iA][iAs][iTs][i$^5$Cs][iTs][iAs][i$^5$Cs][i$^5$Cs][i$^5$Cs][iAs][i$^5$Cs][iAs][lT][i$^5$C][iTs][iGs][iTs][iTs][i$^5$Cs][iAs][iAs][iTs][i$^5$Cs][iA] | 1113 |
| 561 | CGAATCTACCCACATCTGTTCAATCA | 404 | [x][dt][dc][da][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iA][iA][iT][i$^5$Cs][iA] | 1114 |
| 562 | CGAATCTACCCACATCTGTTCAATCA | 2 | [nma$^5$Cs][nmaGs][nmaAs][nmaAs][nmaTs][nma$^5$Cs][nmaTs][nmaAs][nma$^5$Cs][nma$^5$Cs][nma$^5$Cs][nmaAs][nma$^5$Cs][nmaAs][nmaTs][nma$^5$Cs][nmaTs][nmaGs][nmaTs][nmaTs][nma$^5$Cs][nmaAs][nmaAs][nmaTs][nma$^5$Cs][nmaA] | 1115 |
| 563 | ACGAATCTACCCACATCTGTTCAATC | 93 | [nmaAs][nma$^5$Cs][nmaGs][nmaAs][nmaAs][nmaTs][nma$^5$Cs][nmaTs][nmaAs][nma$^5$Cs][nma$^5$Cs][nma$^5$Cs][nmaAs][nma$^5$Cs][nmaAs][nmaTs][nma$^5$Cs][nmaTs][nmaGs][nmaTs][nmaTs][nma$^5$Cs][nmaAs][nmaAs][nmaTs][nma$^5$C] | 1116 |
| 564 | CGAATCTACCCACATCTGTTCAATCA | 2 | [i$^5$Cs][iGs][iAs][iAs][iTs][l$^5$Cs][iTs][iAs][i$^5$Cs][i$^5$Cs][i$^5$Cs][iAs][i$^5$Cs][iAs][iTs][i$^5$Cs][iTs][iGs][iTs][iT][i$^5$Cs][iAs][iAs][iTs][i$^5$Cs][iA] | 1117 |
| 565 | ACGAATCTACCCACATCTGTTCAATC | 93 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iT][i$^5$Cs][iAs][iAs][iTs][i$^5$C] | 1118 |
| 566 | CCATCCATCATCTGTTCAAT | 405 | [l$^5$Cs][i$^5$Cs][iAs][iTs][i$^5$Cs][i$^5$Cs][iAs][iTs][i$^5$Cs][iAs][iTs][i$^5$Cs][iTs][iGs][iTs][iTs][i$^5$Cs][iAs][iAs][lT] | 1119 |
| 567 | CCATCCATGTACTGTTCAAT | 406 | [l$^5$Cs][i$^5$Cs][iAs][iTs][i$^5$Cs][i$^5$Cs][iAs][iTs][iGs][iTs][iAs][i$^5$Cs][iTs][iGs][iTs][iTs][i$^5$Cs][iAs][iAs][lT] | 1120 |
| 568 | CCATCCATGTACTTTCAATC | 407 | [l$^5$Cs][i$^5$Cs][iAs][iTs][i$^5$Cs][i$^5$Cs][iAs][iTs][iGs][iTs][iAs][l$^5$Cs][iTs][iTs][iTs][i$^5$Cs][iAs][iAs][iTs][l$^5$C] | 1121 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 569 | CCATCCATGTACTTCAATCA | 408 | [l$^{5}$Cs][i$^{5}$Cs][iAs][iTs][i$^{5}$Cs][i$^{5}$Cs][iAs][iTs][iGs][iTs][iAs][l$^{5}$Cs][iTs][iTs][i$^{5}$Cs][iAs][iAs][iTs][i$^{5}$Cs][lA] | 1122 |
| 570 | ACGAATCTACCCAATCCTTTTATCTA | 409 | [iAs][i$^{5}$Cs][iGs][iAs][iAs][iTs][i$^{5}$Cs][iTs][iAs][i$^{5}$Cs][i$^{5}$Cs][i$^{5}$Cs][iAs][iAs][iTs][i$^{5}$Cs][i$^{5}$Cs][iTs][iTs][iTs][iTs][iAs][iTs][i$^{5}$Cs][iTs][iA] | 1123 |
| 571 | CGAATCTACCCACATCCTTTTATCTA | 410 | [i$^{5}$Cs][iGs][iAs][iAs][iTs][i$^{5}$Cs][iTs][iAs][i$^{5}$Cs][i$^{5}$Cs][i$^{5}$Cs][iAs][i$^{5}$Cs][iAs][iTs][i$^{5}$Cs][i$^{5}$Cs][iTs][iTs][iTs][iTs][iAs][iTs][i$^{5}$Cs][iTs][iA] | 1124 |
| 572 | CACGAATCTACCCCTTTTATCTACTC | 411 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][i$^{5}$Cs][iTs][iTs][iTs][iTs][iAs][iTs][i$^{5}$Cs][iTs][iAs][i$^{5}$Cs][iTs][i$^{5}$C] | 1125 |
| 573 | ACGAATCTACCCATCCTTTTATCTAC | 412 | [iAs][i$^{5}$Cs][iGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iTs][iTs][iTs][iTs][iAs][iTs][i$^{5}$Cs][iTs][iAs][i$^{5}$C] | 1126 |
| 574 | ACGAATCTACCCACTTTTATCTACTC | 413 | [iAs][i$^{5}$Cs][iGs][iAs][iAs][iTs][i$^{5}$Cs][iTs][iAs][i$^{5}$Cs][l$^{5}$Cs][i$^{5}$Cs][iAs][i$^{5}$Cs][iTs][iTs][iTs][iTs][iAs][iTs][l$^{5}$Cs][iTs][iAs][i$^{5}$Cs][iTs][i$^{5}$C] | 1127 |
| 575 | CACGAATCTACCCATCCTTTTATCTA | 414 | [i$^{5}$Cs][iAs][i$^{5}$Cs][iGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iTs][iTs][iTs][iTs][iAs][iTs][i$^{5}$Cs][iTs][iA] | 1128 |
| 576 | CCATCCATGTACTTTTTATC | 415 | [l$^{5}$Cs][i$^{5}$Cs][iAs][iTs][i$^{5}$Cs][i$^{5}$Cs][iAs][iTs][iGs][iTs][iAs][i$^{5}$Cs][iTs][iTs][iTs][iTs][iTs][iAs][iTs][l$^{5}$C] | 1129 |
| 577 | CCATCCATGTACTCTTTTAT | 416 | [l$^{5}$Cs][i$^{5}$Cs][iAs][iTs][i$^{5}$Cs][i$^{5}$Cs][iAs][iTs][iGs][iTs][iAs][i$^{5}$Cs][iTs][i$^{5}$Cs][iTs][iTs][iTs][iTs][iAs][lT] | 1130 |
| 578 | CCATCCATGTACTTGTACTC | 417 | [l$^{5}$Cs][i$^{5}$Cs][iAs][iTs][i$^{5}$Cs][i$^{5}$Cs][iAs][iTs][iGs][iTs][iAs][i$^{5}$Cs][iTs][iTs][iGs][iTs][iAs][i$^{5}$Cs][iTs][l$^{5}$C] | 1131 |
| 579 | CGAATCTACCCACCATCCATGTACTC | 418 | [i$^{5}$Cs][iGs][iAs][iAs][iTs][i$^{5}$Cs][iTs][iAs][i$^{5}$Cs][l$^{5}$Cs][i$^{5}$Cs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iTs][i$^{5}$C] | 1132 |
| 580 | CGAATCTACCCACATCCATGTACTCA | 419 | [i$^{5}$Cs][iGs][iAs][iAs][iTs][i$^{5}$Cs][iTs][iAs][i$^{5}$Cs][i$^{5}$C | 1133 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| | | | s][i$^5$Cs][iAs][i$^5$Cs][iAs][iTs][i$^5$Cs][i$^5$Cs][iAs][iTs][iGs][iTs][iAs][i$^5$Cs][iTs][i$^5$Cs][iA] | |
| 581 | GCCACGAATCTACTCCATGTACTCAC | 420 | [iGs][i$^5$Cs][i$^5$Cs][iAs][i$^5$Cs][iGs][iAs][iAs][iTs][i$^5$Cs][iTs][iAs][i$^5$Cs][iTs][i$^5$Cs][i$^5$Cs][iAs][iTs][iGs][iTs][iAs][i$^5$Cs][iTs][i$^5$Cs][iAs][i$^5$C] | 1134 |
| 582 | ACGAATCTACCCACATCCATGTACTC | 421 | [iAs][i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][i$^5$Cs][iAs][iTs][iGs][iTs][iAs][i$^5$Cs][iTs][i$^5$C] | 1135 |
| 583 | ACGAATCTACCCAATCCATGTACTCA | 422 | [iAs][il$^5$Cs][iGs][iAs][iAs][iTs][i$^5$Cs][iTs][iAs][i$^5$Cs][i$^5$Cs][i$^5$Cs][iAs][iAs][iTs][i$^5$Cs][i$^5$Cs][iAs][iTs][iGs][iTs][iAs][i$^5$Cs][iTs][i$^5$Cs][iA] | 1136 |
| 584 | CGAATCTACCCACTCCATGTACTCAC | 423 | [i$^5$Cs][iGs][iAs][iAs][iTs][i$^5$Cs][iTs][iAs][i$^5$Cs][i$^5$Cs][i$^5$Cs][iAs][i$^5$Cs][iTs][i$^5$Cs][i$^5$Cs][iAs][iTs][iGs][iTs][iAs][i$^5$Cs][iTs][i$^5$Cs][iAs][i$^5$C] | 1137 |
| 585 | CACGAATCTACCCCATCCATGTACTC | 3 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iT][iG][iT][iA][i$^5$C][iTs][i$^5$C] | 1138 |
| 586 | ACGAATCTACCCATCCATGTACTC | 424 | [iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][iTs][i$^5$C] | 1139 |
| 587 | ACGAATCCATCCATGTACTC | 425 | [lAs][l$^5$Cs][iGs][iAs][iAs][iTs][i$^5$Cs][i$^5$Cs][iAs][iTs][i$^5$Cs][i$^5$Cs][iAs][iTs][iGs][iTs][iAs][i$^5$Cs][lTs][l$^5$C] | 1140 |
| 588 | ACGAATCATCCATGTACTCA | 426 | [lAs][l$^5$Cs][iGs][iAs][iAs][iTs][i$^5$Cs][iAs][iTs][l$^5$Cs][i$^5$Cs][iAs][iTs][iGs][iTs][iAs][i$^5$Cs][iTs][l$^5$Cs][lA] | 1141 |
| 589 | CGAATCTCATCCATGTACTC | 427 | [l$^5$Cs][lGs][iAs][iAs][iTs][i$^5$Cs][iTs][i$^5$Cs][iAs][iTs][i$^5$Cs][i$^5$Cs][iAs][iTs][iGs][iTs][iAs][i$^5$Cs][lTs][l$^5$C] | 1142 |
| 590 | CGAATCTATCCATGTACTCA | 428 | [l$^5$Cs][lGs][iAs][iAs][iTs][i$^5$Cs][iTs][iAs][iTs][i$^5$Cs][i$^5$Cs][iAs][iTs][iGs][iTs][iAs][i$^5$Cs][iTs][l$^5$Cs][lA] | 1143 |
| 591 | GAATCTACATCCATGTACTC | 429 | [lGs][lAs][iAs][iTs][i$^5$Cs][iTs][iAs][i$^5$Cs][iAs][iTs][i$^5$Cs][i$^5$Cs][iAs][iTs][iGs][iTs][iAs][i$^5$Cs][lTs][l$^5$C] | 1144 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 592 | AATCTACCATCCATGTACTC | 430 | [lAs][lAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][lTs][l$^{5}$C] | 1145 |
| 593 | ACGAATCCATCCATGTACTC | 425 | [lAs][l$^{5}$C][iG][iAs][iAs][iTs][i$^{5}$Cs][i$^{5}$Cs][iAs][iTs][i$^{5}$Cs][i$^{5}$Cs][iAs][iTs][iGs][iTs][iAs][i$^{5}$Cs][lTs][l$^{5}$C] | 1146 |
| 594 | ACGAATCCATCCATGTACTC | 425 | [lAs][l$^{5}$Cs][iGs][iAs][iAs][iTs][i$^{5}$Cs][i$^{5}$Cs][iAs][iTs][i$^{5}$Cs][i$^{5}$Cs][iAs][iTs][iGs][iTs][iA][i$^{5}$C][lTs][l$^{5}$C] | 1147 |
| 595 | GAATCTACCCATCTCTCCAT | 431 | [lGs][lAs][iAs][iTs][i$^{5}$Cs][iTs][iAs][i$^{5}$Cs][i$^{5}$Cs][i$^{5}$Cs][iAs][iTs][i$^{5}$Cs][iTs][i$^{5}$Cs][iTs][i$^{5}$Cs][l$^{5}$Cs][lAs][lT] | 1148 |
| 596 | TCCATCATCCATGTACTCAC | 432 | [lTs][l$^{5}$Cs][i$^{5}$Cs][iAs][iTs][i$^{5}$Cs][iAs][iTs][i$^{5}$Cs][i$^{5}$Cs][iAs][iTs][iGs][iTs][iAs][i$^{5}$Cs][iTs][i$^{5}$Cs][lAs][l$^{5}$C] | 1149 |
| 597 | GAATCTACCCATCCATGTAC | 433 | [lGs][lAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iTs][iGs][iTs][lAs][l$^{5}$C] | 1150 |
| 598 | CGAATCTACCATCCATGTAC | 82 | [l$^{5}$Cs][iG][iA][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$C] | 1151 |
| 599 | CGAATCTACCATCCATGTAC | 82 | [i$^{5}$Cs][iGs][iAs][iAs][iTs][i$^{5}$Cs][iTs][iA][i$^{5}$C][i$^{5}$Cs][iAs][iTs][i$^{5}$Cs][i$^{5}$Cs][iAs][iTs][iGs][iTs][iAs][i$^{5}$C] | 1152 |
| 600 | CGAATCTACCATCCATGTAC | 82 | [i$^{5}$Cs][iGs][iAs][iAs][iTs][i$^{5}$Cs][iTs][iAs][i$^{5}$Cs][i$^{5}$Cs][iAs][iT][i$^{5}$C][i$^{5}$Cs][iAs][iTs][iGs][iTs][iAs][i$^{5}$C] | 1153 |
| 601 | CGAATCTACCATCCATGTAC | 82 | [i$^{5}$Cs][iGs][iAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iG][iT][iAs][i$^{5}$C] | 1154 |
| 602 | CCATCCATGTACTTCACCCA | 434 | [i$^{5}$Cs][i$^{5}$Cs][iAs][iTs][i$^{5}$Cs][i$^{5}$Cs][iAs][iTs][iGs][iTs][iAs][i$^{5}$Cs][iTs][iTs][i$^{5}$Cs][iAs][i$^{5}$Cs][i$^{5}$Cs][i$^{5}$Cs][lA] | 1155 |
| 603 | CAATCATCCATCCATGTACT | 435 | [l$^{5}$Cs][lAs][iAs][iTs][i$^{5}$Cs][iAs][iTs][i$^{5}$Cs][i$^{5}$Cs][iAs][iTs][i$^{5}$Cs][i$^{5}$Cs][iAs][iTs][iGs][iTs][iAs][l$^{5}$Cs][lT] | 1156 |
| 604 | CAATCATCCATCCATGTACT | 435 | [l$^{5}$Cs][lA][iA][iTs][i$^{5}$Cs][iAs][iTs][i$^{5}$Cs][i$^{5}$Cs][iAs][iTs][l$^{5}$Cs][l$^{5}$Cs][iAs][iTs][iGs][iTs][iAs][l$^{5}$Cs][lT] | 1157 |
| 605 | CAATCATCCATCCATGTACT | 435 | [l$^{5}$Cs][lAs][iAs][iTs][i$^{5}$Cs][iAs][iTs][i$^{5}$Cs][i$^{5}$Cs][iA | 1158 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| | | | s][iTs][i$^5$Cs][i$^5$Cs][iAs][iTs][iGs][iT][iA][l$^5$Cs][lT] | |
| 606 | GTTCAATCCATCCATGTACT | 436 | [lGs][lTs][iTs][i$^5$Cs][iAs][iAs][iTs][i$^5$Cs][l$^5$Cs][iAs][iTs][i$^5$Cs][i$^5$Cs][iAs][iTs][iGs][iTs][iAs][l$^5$Cs][lT] | 1159 |
| 607 | TTCAATCCCATCCATGTACT | 437 | [lTs][lTs][i$^5$Cs][iAs][iAs][iTs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1160 |
| 608 | TCAATCACCATCCATGTACT | 438 | [lTs][l$^5$Cs][iAs][iAs][iTs][i$^5$Cs][iAs][i$^5$Cs][i$^5$Cs][iAs][iTs][i$^5$Cs][i$^5$Cs][iAs][iTs][iGs][iTs][iAs][l$^5$Cs][lT] | 1161 |
| 609 | TTTTATCCCATCCATGTACT | 439 | [lTs][lTs][iTs][iTs][iAs][iTs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1162 |
| 610 | CTTTTATCCATCCATGTACT | 440 | [l$^5$Cs][lTs][iTs][iTs][iTs][iAs][iTs][i$^5$Cs][i$^5$Cs][iAs][iTs][i$^5$Cs][i$^5$Cs][iAs][iTs][iGs][iTs][iAs][l$^5$Cs][lT] | 1163 |
| 611 | TCACCCACCATCCATGTACT | 441 | [lTs][l$^5$Cs][iAs][i$^5$Cs][i$^5$Cs][i$^5$Cs][iAs][i$^5$Cs][i$^5$Cs][iAs][iTs][i$^5$Cs][i$^5$Cs][iAs][iTs][iGs][iTs][iAs][l$^5$Cs][lT] | 1164 |
| 612 | CCATCCATGTACTCCATCCATGTACT | 442 | [i$^5$Cs][i$^5$Cs][iAs][iTs][i$^5$Cs][i$^5$Cs][iAs][iTs][iGs][iTs][iAs][i$^5$Cs][iTs][i$^5$Cs][i$^5$Cs][iAs][iTs][i$^5$Cs][i$^5$Cs][iAs][iTs][iGs][iTs][iAs][i$^5$Cs][iT] | 1165 |
| 613 | CCATCCATGTACT[n3]CCATCCATGTACT | 246/246 | [i$^5$Cs][i$^5$Cs][iAs][iTs][i$^5$Cs][i$^5$Cs][iAs][iTs][iGs][iTs][iAs][i$^5$Cs][iTs][n3s][i$^5$Cs][i$^5$Cs][iAs][iTs][i$^5$Cs][i$^5$Cs][iAs][iTs][iGs][iTs][iAs][i$^5$Cs][iT] | 1166/1167 |
| 614 | CCATCCATCATCC[n6]GGGATAAGAGTTC | 198/253 | [i$^5$Cs][i$^5$Cs][iAs][iTs][i$^5$Cs][i$^5$Cs][iAs][iTs][i$^5$Cs][iAs][iTs][i$^5$Cs][i$^5$Cs][n6s][iGs][iGs][iGs][iAs][iTs][iAs][iAs][iGs][iAs][iGs][iTs][iTs][i$^5$C] | 1168/1169 |
| 615 | GCCACGAATCTACTCCATCCATGTAC | 445 | [iGs][i$^5$Cs][i$^5$Cs][iAs][i$^5$Cs][iGs][iAs][iAs][iTs][i$^5$Cs][iTs][iAs][i$^5$Cs][iTs][i$^5$Cs][i$^5$Cs][iAs][iTs][i$^5$Cs][i$^5$Cs][iAs][iTs][iGs][iTs][iAs][iC] | 1170 |
| 616 | GCCACGAATCTACCCATCCATGTACT | 446 | [iGs][i$^5$Cs][i$^5$Cs][iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][iT] | 1171 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 617 | CACGAATCTACCCTCCATCCATGTAC | 447 | [i$^5$Cs][iAs][i$^5$Cs][iGs][iAs][iAs][iTs][i$^5$Cs][iTs][iAs][i$^5$Cs][i$^5$Cs][i$^5$Cs][iTs][i$^5$Cs][i$^5$Cs][iAs][iTs][i$^5$Cs][i$^5$Cs][iAs][iTs][iGs][iTs][iAs][i$^5$C] | 1172 |
| 618 | ACGAATCTACCCACCATCCATGTACT | 448 | [iAs][i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][iAs][iTs][i$^5$Cs][i$^5$Cs][iAs][iTs][iGs][iTs][iAs][i$^5$Cs][iT] | 1173 |
| 619 | CCACGAATCTACCCCATCCATGTACT | 449 | [i$^5$Cs][i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][iT] | 1174 |
| 620 | CACGAATCTACCCCCATCCATGTACT | 1 | [l$^5$Cs][lAs][i$^5$Cs][iGs][iAs][iAs][iTs][i$^5$Cs][iTs][iAs][i$^5$Cs][l$^5$Cs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1175 |
| 621 | CACGAATCTACCCCCATCCATGTACT | 1 | [i$^5$Cs][iAs][i$^5$Cs][iGs][iAs][iAs][iTs][i$^5$Cs][iTs][iAs][i$^5$Cs][i$^5$Cs][i$^5$Cs][i$^5$Cs][l$^5$C][lA][iTs][i$^5$Cs][i$^5$Cs][iAs][iTs][iGs][iTs][iAs][i$^5$Cs][iT] | 1176 |
| 622 | ACGAATCTACCCCCATCCATGTAC | 37 | [iAs][i$^5$C][iG][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$C] | 1177 |
| 623 | ACGAATCTACCCCCATCCATGTAC | 37 | [iAs][i$^5$Cs][iGs][iAs][iAs][iTs][i$^5$Cs][iTs][iAs][i$^5$C][i$^5$C][i$^5$Cs][i$^5$Cs][i$^5$Cs][iAs][iTs][i$^5$Cs][i$^5$Cs][iAs][iTs][iGs][iTs][iAs][i$^5$C] | 1178 |
| 624 | ACGAATCTACCCCCATCCATGTAC | 37 | [iAs][i$^5$Cs][iGs][iAs][iAs][iTs][i$^5$Cs][iTs][iAs][i$^5$Cs][i$^5$Cs][i$^5$Cs][i$^5$Cs][i$^5$C][iA][iTs][i$^5$Cs][i$^5$Cs][iAs][iTs][iGs][iTs][iAs][i$^5$C] | 1179 |
| 625 | ACGAATCTACCCCCATCCATGTAC | 37 | [iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iG][iT][iAs][i$^5$C] | 1180 |
| 626 | ACGAATCTACCCCCATCCATGTAC | 37 | [iAs][i$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][ | 1181 |
| 627 | ACGAATCTATCCATCCATGTAC | 450 | [iAs][i$^5$Cs][iGs][iAs][iAs][iTs][i$^5$Cs][iTs][iAs][iTs][i$^5$Cs][i$^5$Cs][iAs][iTs][i$^5$Cs][i$^5$Cs][iAs][iTs][iGs][iTs][iAs][i$^5$C] | 1182 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 628 | CGAATCTACCCACCCATCCATGTACT | 451 | [i$^5$Cs][iGs][iAs][iAs][iTs][i$^5$Cs][iTs][iAs][i$^5$Cs][i$^5$Cs][i$^5$Cs][iAs][i$^5$Cs][i$^5$Cs][i$^5$Cs][iAs][iTs][i$^5$Cs][i$^5$Cs][iAs][iTs][iGs][iTs][iAs][i$^5$Cs][iT] | 1183 |
| 629 | ACGAATCCCATCCATGTACT | 452 | [lAs][l$^5$Cs][iGs][iAs][iAs][iTs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1184 |
| 630 | GCCACGACCATCCATGTACT | 453 | [lGs][l$^5$Cs][i$^5$Cs][iAs][i$^5$Cs][iGs][iAs][i$^5$Cs][i$^5$Cs][iAs][iTs][i$^5$Cs][i$^5$Cs][iAs][iTs][iGs][iTs][iAs][l$^5$Cs][lT] | 1185 |
| 631 | CGAATCTCCATCCATGTACT | 454 | [l$^5$Cs][lGs][iAs][iAs][iTs][i$^5$Cs][iTs][i$^5$Cs][i$^5$Cs][iAs][iTs][i$^5$Cs][i$^5$Cs][iAs][iTs][iGs][iTs][iAs][l$^5$Cs][lT] | 1186 |
| 632 | GAATCTACCATCCATGTACT | 455 | [lGs][lAs][iAs][iTs][i$^5$Cs][iTs][iAs][i$^5$Cs][l$^5$Cs][iAs][iTs][i$^5$Cs][i$^5$Cs][iAs][iTs][iGs][iTs][iAs][l$^5$Cs][lT] | 1187 |
| 633 | AATCTACCCATCCATGTACT | 456 | [lAs][lAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1188 |
| 634 | ACGAATCTCCATCCATGTAC | 457 | [lAs][l$^5$Cs][iGs][iAs][iAs][iTs][i$^5$Cs][iTs][i$^5$Cs][i$^5$Cs][iAs][iTs][i$^5$Cs][i$^5$Cs][iAs][iTs][iGs][iTs][lAs][l$^5$C] | 1189 |
| 635 | CGAATCTTCCATCCATGTAC | 458 | [l$^5$Cs][lGs][iAs][iAs][iTs][i$^5$Cs][iTs][iTs][i$^5$Cs][i$^5$Cs][iAs][iTs][i$^5$Cs][i$^5$Cs][iAs][iTs][iGs][iTs][lAs][l$^5$C] | 1190 |
| 636 | GAATCTATCCATCCATGTAC | 459 | [lGs][lAs][iAs][iTs][i$^5$Cs][iTs][iAs][iTs][i$^5$Cs][i$^5$Cs][iAs][iTs][i$^5$Cs][i$^5$Cs][iAs][iTs][iGs][iTs][lAs][l$^5$C] | 1191 |
| 637 | GAATCTACCATCCATGTACT | 455 | [lGs][lA][iA][iTs][i$^5$Cs][iTs][iAs][i$^5$Cs][i$^5$Cs][iAs][iTs][i$^5$Cs][i$^5$Cs][iAs][iTs][iGs][iTs][iAs][l$^5$Cs][lT] | 1192 |
| 638 | GAATCTACCATCCATGTACT | 455 | [lGs][lA][iA][iT][i$^5$Cs][iTs][iAs][i$^5$Cs][i$^5$Cs][iAs][iTs][i$^5$Cs][i$^5$Cs][iAs][iTs][iGs][iTs][iAs][l$^5$Cs][lT] | 1193 |
| 639 | GAATCTACCATCCATGTACT | 455 | [lGs][lAs][iAs][iTs][i$^5$Cs][iTs][iAs][i$^5$Cs][i$^5$Cs][iAs][iTs][i$^5$Cs][i$^5$Cs][iAs][iTs][iGs][iT][iA][l$^5$Cs][lT] | 1194 |
| 640 | GAATCTACCATCCATGTACT | 455 | [lGs][lAs][iAs][iTs][i$^5$Cs][iTs][iAs][i$^5$Cs][i$^5$Cs][iAs][iTs][i$^5$Cs][i$^5$Cs][iAs][iTs][iG][iT][iA][l$^5$Cs][lT] | 1195 |

TABLE 11-continued

| ASO # | Nucleobase Sequence (5' → 3') | SEQ ID NO: | Antisense Oligonucleotide Structures (5' → 3') | SEQ ID NO: |
|---|---|---|---|---|
| | | | Exemplary antisense oligonucleotides | |
| 641 | GAATCTACCATCCATGTACT | 455 | [lGs][lAs][iAs][iTs][i$^5$Cs][lT][lA][i$^5$Cs][i$^5$Cs][iAs][iTs][i$^5$Cs][i$^5$Cs][iAs][iTs][iGs][iTs][iAs][l$^5$Cs][lT] | 1196 |
| 642 | GAATCTACCATCCATGTACT | 455 | [lGs][lAs][iAs][iTs][i$^5$Cs][iTs][iAs][l$^5$C][l$^5$C][iAs][iTs][i$^5$Cs][l$^5$Cs][iAs][iTs][iGs][iTs][iAs][l$^5$Cs][lT] | 1197 |
| 643 | GAATCTACCATCCATGTACT | 455 | [lGs][lAs][iAs][iTs][i$^5$Cs][iTs][lA][l$^5$C][i$^5$Cs][iAs][iTs][i$^5$Cs][i$^5$Cs][iAs][iTs][iGs][iTs][iAs][l$^5$Cs][lT] | 1198 |
| 644 | GAATCTACCATCCATGTACT | 455 | [lGs][lAs][iAs][iTs][i$^5$Cs][iTs][iAs][i$^5$Cs][i$^5$Cs][iAs][iTs][l$^5$C][l$^5$C][iAs][iTs][iGs][iTs][iAs][l$^5$Cs][lT] | 1199 |
| 645 | CGAATCTACCATCCATGTAC | 82 | [l$^5$Cs][lG][iA][iAs][iTs][i$^5$Cs][iTs][iAs][i$^5$Cs][i$^5$Cs][lAs][iTs][i$^5$Cs][i$^5$Cs][iAs][iTs][iGs][iTs][lAs][l$^5$C] | 1200 |
| 646 | CGAATCTACCATCCATGTAC | 82 | [l$^5$Cs][lG][iA][iA][iTs][i$^5$Cs][iTs][iAs][i$^5$Cs][l$^5$Cs][lAs][iTs][i$^5$Cs][i$^5$Cs][iAs][iTs][iGs][iTs][lAs][l$^5$C] | 1201 |
| 647 | ACGAATCTCCATCCATGTAC | 457 | [lAs][l$^5$C][iG][iAs][iAs][iTs][i$^5$Cs][iTs][i$^5$Cs][i$^5$Cs][iAs][iTs][i$^5$Cs][i$^5$Cs][iAs][iTs][iGs][iTs][lAs][l$^5$C] | 1202 |
| 648 | ACGAATCTCCATCCATGTAC | 457 | [lAs][l$^5$Cs][iGs][iAs][iAs][iTs][i$^5$Cs][iTs][i$^5$Cs][l$^5$Cs][iAs][iTs][i$^5$Cs][i$^5$Cs][iAs][iTs][iG][lT][lAs][l$^5$C] | 1203 |
| 649 | ACGAATCCCATCCATGTACT | 452 | [lAs][l$^5$C][iG][iAs][iAs][iTs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1204 |
| 650 | CGAATCTCCATCCATGTACT | 454 | [l$^5$Cs][G][iA][iAs][iTs][i$^5$Cs][iTs][i$^5$Cs][i$^5$Cs][iAs][iTs][l$^5$Cs][l$^5$Cs][iAs][iTs][iGs][iTs][iAs][l$^5$Cs][lT] | 1205 |
| 651 | CGAATCTCCATCCATGTACT | 454 | [l$^5$Cs][lGs][iAs][iAs][iTs][i$^5$Cs][iTs][i$^5$Cs][i$^5$Cs][iAs][iTs][i$^5$Cs][i$^5$Cs][iAs][iTs][iGs][iT][iA][l$^5$Cs][lT] | 1206 |
| 652 | GAATCTACCATCCATGTACT | 455 | [iGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][iT] | 1207 |
| 653 | GAATCTACCATCCATGTACT | 455 | [lGs][iAs][iAs][iTs][i$^5$Cs][iTs][lAs][l$^5$Cs][i$^5$Cs][iAs][iTs][i$^5$Cs][i$^5$Cs][iAs][iTs][iGs][iTs][iAs][i$^5$Cs][lT] | 1208 |
| 654 | GAATCTACCATCCATGTACT | 455 | [lGs][iA][iA][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][lT] | 1209 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 655 | GAATCTACCATCCATGTACT | 455 | [lGs][iAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][lT][iA][i$^{5}$Cs][lT] | 1210 |
| 656 | GAATCTACCATCCATGTACT | 455 | [lGs][iA][iA][iTs][i$^{5}$Cs][iTs][iAs][i$^{5}$Cs][i$^{5}$Cs][iAs][iTs][i$^{5}$Cs][i$^{5}$Cs][iAs][iTs][iGs][iT][iA][i$^{5}$Cs][lT] | 1211 |
| **657** | GAATCTACCATCCATGTACT | **455** | [lGs][iA][iA][iTs][i5Cs][iTs][iA][i$^{5}$C][i$^{5}$Cs][iAs][iTs][i$^{5}$Cs][i$^{5}$Cs][iAs][iTs][iGs][iTs][iAs][i$^{5}$Cs][lT] | **1212** |
| 658 | GAATCTACCATCCATGTACT | 455 | [lGs][iAs][iAs][iTs][i$^{5}$Cs][iTs][iA][i$^{5}$C][i$^{5}$Cs][iAs][iTs][i$^{5}$Cs][i$^{5}$Cs][iAs][iTs][iGs][iT][iA][i$^{5}$Cs][lT] | 1213 |
| 659 | GAATCTACCATCCATGTAC | 460 | [lGs][lAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][lAs][l$^{5}$C] | 1214 |
| 660 | GAATCTACCATCCATGTACT | 455 | [lGs][iAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][lT] | 1215 |
| 661 | GAATCTACCATCCATGTACT | 455 | [lGs][iAs][iAs][iTs][i$^{5}$Cs][iTs][iAs][l$^{5}$Cs][l$^{5}$Cs][iAs][iTs][i$^{5}$Cs][i$^{5}$Cs][iAs][iTs][iGs][iTs][iAs][iCs][lT] | 1216 |
| 662 | GAATCTACCATCCATGTACT | 455 | [lGs][iAs][iAs][iTs][i$^{5}$Cs][iTs][lAs][i$^{5}$Cs][i$^{5}$Cs][lAs][iTs][i$^{5}$Cs][i$^{5}$Cs][iAs][iTs][iGs][iTs][iAs][i$^{5}$Cs][lT] | 1217 |
| 663 | GAATCTACCCATCCATGTACT | 461 | [lGs][iAs][iAs][iTs][i$^{5}$Cs][iTs][iAs][i$^{5}$Cs][l$^{5}$Cs][l$^{5}$Cs][iAs][iTs][i$^{5}$Cs][i$^{5}$Cs][iAs][iTs][iGs][iTs][iAs][i$^{5}$Cs][lT] | 1218 |
| 664 | CGAATCTACCATCCATGTACT | 462 | [l$^{5}$Cs][iGs][iAs][iAs][iTs][i$^{5}$Cs][iTs][iAs][l$^{5}$Cs][l$^{5}$Cs][iAs][iTs][i$^{5}$Cs][i$^{5}$Cs][iAs][iTs][iGs][iTs][iAs][i$^{5}$Cs][lT] | 1219 |
| 665 | ACGAATCTACCATCCATGTACT | 463 | [lAs][i$^{5}$Cs][iGs][iAs][iAs][iTs][i$^{5}$Cs][iTs][iAs][i$^{5}$Cs][l$^{5}$Cs][iAs][iTs][i$^{5}$Cs][i$^{5}$Cs][iAs][iTs][iGs][iTs][iAs][i$^{5}$Cs][lT] | 1220 |
| 666 | CACGAATCTACCATCCATGTACT | 464 | [l$^{5}$Cs][iAs][i$^{5}$Cs][iGs][iAs][iAs][iTs][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][lT] | 1221 |
| 667 | CCACGAATCTACCATCCATGTACT | 465 | [l$^{5}$Cs][i$^{5}$Cs][iAs][i$^{5}$Cs][iGs][iAs][iAs][iTs][i$^{5}$Cs][iTs][iAs][l$^{5}$Cs][i$^{5}$Cs][iAs][iTs][i$^{5}$Cs][i$^{5}$Cs][iAs][iTs][iGs][iTs][iAs][i$^{5}$Cs][iT] | 1222 |
| 668 | CCACGAATCTACCATCCATGTACT | 465 | [i$^{5}$Cs][i$^{5}$Cs][iAs][i$^{5}$Cs][iGs][iAs][iAs][iTs][i$^{5}$Cs][iT | 1223 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| | | | s][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | |
| 669 | GAATCTACCATCCATGTACT | 455 | [lGs][lA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1224 |
| 670 | GAATCTACCATCCATGTACT | 455 | [iGs][iA][lA][lT][l$^{5}$Cs][iTs][iAs][i$^{5}$Cs][i$^{5}$Cs][iAs][iTs][l$^{5}$Cs][i$^{5}$Cs][iAs][iTs][iGs][iTs][iAs][i$^{5}$Cs][iT] | 1225 |
| 671 | GAATCTACCATCCATGTACT | 455 | [iGs][iA][iA][lT][l$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1226 |
| 672 | GAATCTACCATCCATGTACT | 455 | [iGs][iA][iA][iT][i$^{5}$Cs][iTs][lAs][l$^{5}$Cs][i$^{5}$Cs][iAs][iTs][i$^{5}$Cs][i$^{5}$Cs][iAs][iTs][iGs][iTs][iAs][i$^{5}$Cs][iT] | 1227 |
| 673 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1228 |
| 674 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1229 |
| 675 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1230 |
| 676 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][lTs][lGs][iTs][iAs][i$^{5}$Cs][iT] | 1231 |
| 677 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][lTs][lAs][i$^{5}$Cs][lT] | 1232 |
| 678 | GAATCTACCATCCATGTACT | 455 | [iGs][iA][iA][iT][i$^{5}$Cs][iTs][iAs][i$^{5}$Cs][i$^{5}$Cs][iAs][iTs][i$^{5}$Cs][i$^{5}$Cs][iAs][iTs][iGs][iTs][iAs][l$^{5}$Cs][lT] | 1233 |
| 679 | GAATCTACCATCCATGTACT | 455 | [iGs][iA][lA][iT][i$^{5}$Cs][iTs][lAs][i$^{5}$Cs][i$^{5}$Cs][iAs][iTs][i$^{5}$Cs][i$^{5}$Cs][lAs][iTs][iGs][iTs][lAs][i$^{5}$Cs][iT] | 1234 |
| 680 | GAATCTACCATCCATGTACT | 455 | [lGs][iA][iA][lT][i$^{5}$Cs][lTs][iAs][i$^{5}$Cs][i$^{5}$Cs][iAs][iTs][i$^{5}$Cs][i$^{5}$Cs][lAs][iTs][iGs][iTs][iAs][i$^{5}$Cs][iT] | 1235 |
| 681 | GAATCTACCATCCATGTACT | 455 | [iGs][iA][lA][lT][i$^{5}$Cs][iTs][iAs][i$^{5}$Cs][i$^{5}$Cs][iAs][iTs][i$^{5}$Cs][i$^{5}$Cs][iAs][iTs][iGs][lTs][lAs][i$^{5}$Cs][iT] | 1236 |
| 682 | GAATCTACCATCCATGTACT | 455 | [iGs][iA][iA][lT][i$^{5}$Cs][iTs][lAs][l$^{5}$Cs][i$^{5}$Cs][iAs][iTs][i$^{5}$Cs][l$^{5}$Cs][lAs][iTs][iGs][iTs][iAs][i$^{5}$Cs][iT] | 1237 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 683 | GAATCTACCATCCATGTACT | 455 | [lGs][lAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][iT] | 1238 |
| 684 | GAATCTACCATCCATGTACT | 455 | [iGs][iAs][lAs][lTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][iT] | 1239 |
| 685 | GAATCTACCATCCATGTACT | 455 | [iGs][iAs][iAs][iTs][l$^5$Cs][lTs][iAs][i$^5$Cs][i$^5$Cs][iAs][iTs][i$^5$Cs][i$^5$Cs][iAs][iTs][iGs][iTs][iAs][i$^5$Cs][iT] | 1240 |
| 686 | GAATCTACCATCCATGTACT | 455 | [iGs][iAs][iAs][iTs][i$^5$Cs][iTs][lAs][l$^5$Cs][i$^5$Cs][iAs][iTs][i$^5$Cs][i$^5$Cs][iAs][iTs][iGs][iTs][iAs][i$^5$Cs][iT] | 1241 |
| 687 | GAATCTACCATCCATGTACT | 455 | [iGs][iAs][iAs][iTs][i$^5$Cs][iTs][iAs][i$^5$Cs][l$^5$Cs][lAs][iTs][i$^5$Cs][i$^5$Cs][iAs][iTs][iGs][iTs][iAs][i$^5$Cs][iT] | 1242 |
| 688 | GAATCTACCATCCATGTACT | 455 | [iGs][iAs][iAs][iTs][i$^5$Cs][iTs][iAs][i$^5$Cs][i$^5$Cs][iAs][lTs][l$^5$Cs][i$^5$Cs][iAs][iTs][iGs][iTs][iAs][i$^5$Cs][iT] | 1243 |
| 689 | GAATCTACCATCCATGTACT | 455 | [iGs][iAs][iAs][iTs][i$^5$Cs][iTs][iAs][i$^5$Cs][i$^5$Cs][iAs][iTs][i$^5$Cs][l$^5$Cs][lAs][iTs][iGs][iTs][iAs][i$^5$Cs][iT] | 1244 |
| 690 | GAATCTACCATCCATGTACT | 455 | [iGs][iAs][iAs][iTs][i$^5$Cs][iTs][iAs][i$^5$Cs][l$^5$Cs][iAs][iTs][i$^5$Cs][i$^5$Cs][iAs][lTs][lGs][iTs][iAs][i$^5$Cs][iT] | 1245 |
| 691 | GAATCTACCATCCATGTACT | 455 | [iGs][iAs][iAs][iTs][i$^5$Cs][iTs][iAs][i$^5$Cs][i$^5$Cs][iAs][iTs][i$^5$Cs][i$^5$Cs][iAs][iTs][iGs][lTs][lAs][i$^5$Cs][lT] | 1246 |
| 692 | GAATCTACCATCCATGTACT | 455 | [iGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][l$^5$Cs][lT] | 1247 |
| 693 | GAATCTACCATCCATGTACT | 455 | [iGs][iAs][lAs][iTs][i$^5$Cs][iTs][lAs][i$^5$Cs][i$^5$Cs][iAs][iTs][i$^5$Cs][i$^5$Cs][lAs][iTs][iGs][iTs][lAs][i$^5$Cs][iT] | 1248 |
| 694 | GAATCTACCATCCATGTACT | 455 | [lGs][iAs][iAs][iTs][i$^5$Cs][lTs][iAs][i$^5$Cs][i$^5$Cs][iAs][iTs][i$^5$Cs][i$^5$Cs][iAs][iTs][iGs][iTs][iAs][i$^5$Cs][lT] | 1249 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 695 | GAATCTACCATCCATGTACT | 455 | [iGs][iAs][lAs][lTs][i$^5$Cs][iTs][iAs][i$^5$Cs][i$^5$Cs][iAs][iTs][i$^5$Cs][i$^5$Cs][iAs][iTs][iGs][lTs][lAs][i$^5$Cs][iT] | 1250 |
| 696 | GAATCTACCATCCATGTACT | 455 | [iGs][iAs][iAs][iTs][i$^5$Cs][iTs][lAs][l$^5$Cs][i$^5$Cs][iAs][iTs][i$^5$Cs][l$^5$Cs][lAs][iTs][iGs][iTs][iAs][i$^5$Cs][iT] | 1251 |
| 697 | GAATCTACCATCCATGTACT | 455 | [lGs][lA][iA][iT][i$^5$Cs][iTs][iAs][i$^5$Cs][i$^5$Cs][iAs][iTs][i$^5$Cs][i$^5$Cs][iAs][iTs][iG][iT][iA][l$^5$Cs][lT] | 1252 |
| 698 | GAATCTACCATCCATGTACT | 455 | [lGs][lA][iA][iT][i$^5$Cs][iTs][iAs][i$^5$Cs][i$^5$Cs][iAs][iAs][iTs][i$^5$Cs][i$^5$Cs][iAs][iTs][iGs][iT][iA][l$^5$Cs][lT] | 1253 |
| 699 | GAATCTACCATCCATGTACT | 455 | [lGs][iAs][iAs][iT][i$^5$C][iTs][iAs][i$^5$Cs][i$^5$Cs][iAs][iTs][i$^5$Cs][i$^5$Cs][iAs][iTs][iGs][iTs][iAs][i$^5$Cs][lT] | 1254 |
| 700 | GAATCTACCATCCATGTACT | 455 | [lGs][iAs][iAs][iTs][i$^5$Cs][iT][iA][i$^5$Cs][i$^5$Cs][iAs][iTs][i$^5$Cs][l$^5$Cs][iAs][iTs][iGs][iTs][iAs][i$^5$Cs][lT] | 1255 |
| 701 | GAATCTACCATCCATGTACT | 455 | [lGs][iAs][iAs][iTs][i$^5$Cs][iTs][iAs][i$^5$C][i$^5$C][iAs][iTs][i$^5$Cs][i$^5$Cs][iAs][iTs][iGs][iTs][iAs][i$^5$Cs][lT] | 1256 |
| 702 | GAATCTACCATCCATGTACT | 455 | [lGs][iAs][iAs][iTs][i$^5$Cs][iTs][iAs][i$^5$Cs][i$^5$Cs][iA][iT][i$^5$Cs][i$^5$Cs][iAs][iTs][iGs][iTs][iAs][i$^5$Cs][lT] | 1257 |
| 703 | GAATCTACCATCCATGTACT | 455 | [lGs][iAs][iAs][iTs][i$^5$Cs][iTs][iAs][i$^5$Cs][i$^5$Cs][iAs][iTs][i$^5$C][i$^5$C][iAs][iTs][iGs][iTs][iAs][i$^5$Cs][lT] | 1258 |
| 704 | GAATCTACCATCCATGTACT | 455 | [lGs][iAs][iAs][iTs][i$^5$Cs][iTs][iAs][i$^5$Cs][i$^5$Cs][iAs][iTs][i$^5$Cs][i$^5$Cs][iA][iT][iGs][iTs][iAs][i$^5$Cs][lT] | 1259 |
| 705 | GAATCTACCATCCATGTACT | 455 | [lGs][iAs][iAs][iTs][i$^5$Cs][iTs][iAs][i$^5$Cs][i$^5$Cs][iAs][iTs][i$^5$Cs][i$^5$Cs][iAs][iTs][iG][iT][iAs][i$^5$Cs][lT] | 1260 |
| 706 | GAATCTACCCATCCATGTACT | 461 | [lGs][iA][iA][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1261 |
| 707 | GAATCTACCCATCCATGTACT | 461 | [lGs][iAs][iAs][iT][i$^5$C][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1262 |
| 708 | GAATCTACCCATCCATGTACT | 461 | [lGs][iAs][iAs][iTs][i$^5$Cs][iT][iA][i$^5$Cs][i$^5$Cs][i$^5$Cs][iAs][iTs][i$^5$Cs][i$^5$Cs][iAs][iTs][iGs][iTs][iAs][i$^5$Cs][lT] | 1263 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 709 | GAATCTACCCATCCATGTACT | 461 | i$^{5}$Cs][iAs][iTs][i$^{5}$Cs][i$^{5}$Cs][iAs][iTs][iGs][iTs][iAs][i$^{5}$Cs][lT] | 1264 |
| 710 | GAATCTACCCATCCATGTACT | 461 | [lGs][iAs][iAs][iTs][i$^{5}$Cs][iTs][iAs][i$^{5}$Cs][i$^{5}$Cs][i$^{5}$C][iA][iTs][i$^{5}$Cs][i$^{5}$Cs][iAs][iTs][iGs][iTs][iAs][i$^{5}$Cs][lT] | 1265 |
| 711 | GAATCTACCCATCCATGTACT | 461 | [lGs][iAs][iAs][iTs][i$^{5}$Cs][iTs][iAs][i$^{5}$Cs][i$^{5}$Cs][i$^{5}$Cs][iAs][iT][i$^{5}$C][i$^{5}$Cs][iAs][iTs][iGs][iTs][iAs][i$^{5}$Cs][lT] | 1266 |
| 712 | GAATCTACCCATCCATGTACT | 461 | [lGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$C][iA][iTs][iGs][iTs][iAs][l$^{5}$Cs][lT] | 1267 |
| 713 | GAATCTACCCATCCATGTACT | 461 | [lGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iT][iG][iTs][iAs][i$^{5}$Cs][lT] | 1268 |
| 714 | GAATCTACCCATCCATGTACT | 461 | [lGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iTs][iGs][iT][iAs][i$^{5}$Cs][lT] | 1269 |
| 715 | GAATCTACCCATCCATGTACT | 461 | [lGs][lAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1270 |
| 716 | GAATCTACCCATCCATGTACT | 461 | [iGs][iAs][lAs][lTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1271 |
| **717** | GAATCTACCCATCCATGTACT | **461** | [iGs][iAs][iAs][iTs][l5Cs][lTs][iAs][i$^{5}$Cs][i$^{5}$Cs][i$^{5}$Cs][iAs][iTs][i$^{5}$Cs][i$^{5}$Cs][iAs][iTs][iGs][lTs][iAs][i$^{5}$Cs][iT] | **1272** |
| 718 | GAATCTACCCATCCATGTACT | 461 | [iGs][iAs][iAs][iTs][i$^{5}$Cs][iTs][lAs][i$^{5}$Cs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1273 |
| 719 | GAATCTACCCATCCATGTACT | 461 | [iGs][iAs][iAs][iTs][i$^{5}$Cs][iTs][iAs][i$^{5}$Cs][i$^{5}$Cs][i$^{5}$Cs][iAs][iTs][i$^{5}$Cs][i$^{5}$Cs][iAs][iTs][iGs][iTs][iAs][i$^{5}$Cs][iT] | 1274 |
| 720 | GAATCTACCCATCCATGTACT | 461 | [iGs][iAs][iAs][iTs][i$^{5}$Cs][iTs][iAs][i$^{5}$Cs][i$^{5}$Cs][i$^{5}$Cs][lAs][lTs][i$^{5}$Cs][i$^{5}$Cs][iAs][iTs][iGs][iTs][iAs][i$^{5}$Cs][iT] | 1275 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 721 | GAATCTACCCATCCATGTACT | 461 | [iGs][iAs][iAs][iTs][i$^5$Cs][iTs][iAs][i$^5$Cs][i$^5$Cs][i$^5$Cs][iAs][iTs][l$^5$Cs][l$^5$Cs][iAs][iTs][iGs][iTs][iAs][i$^5$Cs][iT] | 1276 |
| 722 | GAATCTACCCATCCATGTACT | 461 | [iGs][iAs][iAs][iTs][i$^5$Cs][iTs][iAs][i$^5$Cs][l$^5$Cs][l$^5$Cs][iAs][iTs][i$^5$Cs][i$^5$Cs][lAs][lTs][iGs][lTs][iAs][l$^5$Cs][lT] | 1277 |
| 723 | GAATCTACCCATCCATGTACT | 461 | [iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][lGs][lTs][iAs][i$^5$Cs][iT] | 1278 |
| 724 | GAATCTACCCATCCATGTACT | 461 | [iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][lAs][l$^5$Cs][lT] | 1279 |
| 725 | GAATCTACCCATCCATGTACT | 461 | [iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1280 |
| 726 | GAATCTACCCATCCATGTACT | 461 | [iGs][iAs][iAs][iTs][i$^5$Cs][iTs][iAs][i$^5$Cs][i$^5$Cs][i$^5$C][l$^5$Cs][iAs][iTs][i$^5$Cs][i$^5$Cs][iAs][iTs][iGs][iTs][iAs][l$^5$Cs][iT] | 1281 |
| 727 | GAATCTACCCATCCATGTACT | 461 | [iGs][iAs][iAs][lTs][i$^5$Cs][iTs][iAs][i$^5$Cs][i$^5$Cs][l$^5$Cs][iAs][iTs][l$^5$Cs][i$^5$Cs][iAs][iTs][iGs][lTs][iAs][l$^5$Cs][lT] | 1282 |
| 728 | GAATCTACCCATCCATGTACT | 461 | [iGs][iAs][iAs][iTs][i$^5$Cs][lTs][iAs][i$^5$Cs][i$^5$Cs][i$^5$Cs][iAs][iTs][i$^5$Cs][i$^5$Cs][iAs][lTs][iGs][iTs][iAs][i$^5$Cs][iT] | 1283 |
| 729 | GAATCTACCCATCCATGTACT | 461 | [iGs][iAs][iAs][iTs][i$^5$Cs][iTs][iAs][l$^5$Cs][i$^5$Cs][i$^5$Cs][iAs][iTs][i$^5$Cs][l$^5$Cs][iAs][iTs][iGs][iTs][iAs][i$^5$Cs][lT] | 1284 |
| 730 | GAATCTACCATCCATGTACT | 455 | [iGs][lAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][l$^5$Cs][iT] | 1285 |
| 731 | GAATCTACCATCCATGTACT | 455 | [iGs][iAs][iAs][lTs][i$^5$Cs][iTs][iAs][i$^5$Cs][i$^5$Cs][iAs][iTs][i$^5$Cs][i$^5$Cs][iAs][iTs][iGs][lTs][iAs][i$^5$Cs][iT] | 1286 |
| 732 | GAATCTACCATCCATGTACT | 455 | [iGs][iAs][iAs][iTs][i$^5$Cs][lTs][iAs][i$^5$Cs][i$^5$Cs][iAs][iTs][i$^5$Cs][i$^5$Cs][iAs][lTs][iGs][iTs][iAs][i$^5$Cs][iT] | 1287 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 733 | GAATCTACCATCCATGTACT | 455 | [iGs][iAs][iAs][iTs][i$^5$Cs][iTs][iAs][l$^5$Cs][l$^5$Cs][iAs][iTs][i$^5$Cs][l$^5$Cs][iAs][iTs][iGs][iTs][iAs][i$^5$Cs][iT] | 1288 |
| 734 | GAATCTACCATCCATGTACT | 455 | [enaGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][enaT] | 1289 |
| 735 | GAATCTACCATCCATGTACT | 455 | [bGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][bT] | 1290 |
| 736 | GAATCTACCCATCCATGTACT | 461 | [enaGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][enaT] | 1291 |
| 737 | GAATCTACCCATCCATGTACT | 461 | [scpGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][scpT] | 1292 |
| 738 | GAATCTACCCATCCATGTACT | 461 | [bGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][bT] | 1293 |
| 739 | GAATCTACCATCCATGTACT | 455 | [lGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][l$^5$Cs][iT] | 1294 |
| 740 | GAATCTACCATCCATGTACT | 455 | [iGs][zAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][z$^5$Cs][iT] | 1295 |
| 741 | GAATCTACCATCCATGTACT | 455 | [enaGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][ena$^5$Cs][iT] | 1296 |
| 742 | GAATCTACCATCCATGTACT | 455 | [iGs][enaAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][ena$^5$Cs][iT] | 1297 |
| 743 | GAATCTACCATCCATGTACT | 455 | [iGs][enaAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][enaT] | 1298 |
| 744 | GAATCTACCCATCCATGTACT | 461 | [lGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][iT] | 1299 |
| 745 | GAATCTACCCATCCATGTACT | 461 | [iGs][lAs][iAs][iTs][i$^5$Cs][iTs][iAs][i$^5$Cs][i$^5$Cs][i$^5$Cs][iAs][iTs][i$^5$Cs][i$^5$Cs][i | 1300 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| | | | As][iTs][iGs][iTs][iAs][i$^5$Cs][lT] | |
| 746 | GAATCTACCCATCCATGTACT | 461 | [iGs][zAs][iAs][iTs][l$^5$Cs][iTs][iAs][i$^5$Cs][i$^5$Cs][i$^5$Cs][iAs][iTs][i$^5$Cs][l$^5$Cs][iAs][iTs][iGs][iTs][iAs][z$^5$Cs][lT] | 1301 |
| 747 | GAATCTACCCATCCATGTACT | 461 | [iGs][scpAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][scpT] | 1302 |
| 748 | GAATCTACCCATCCATGTACT | 461 | [enaGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][ena$^5$Cs][iT] | 1303 |
| 749 | GAATCTACCCATCCATGTACT | 461 | [iGs][enaAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][ena$^5$Cs][iT] | 1304 |
| 750 | GAATCTACCCATCCATGTACT | 461 | [iGs][enaAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][enaT] | 1305 |
| 751 | GAATCTACCATCCATGTACT | 466 | [x][dt][dc][da][lGs][iAs][iAs][iTs][i$^5$Cs][iTs][iAs][l$^5$Cs][i$^5$Cs][iAs][iTs][i$^5$Cs][i$^5$Cs][iAs][iTs][iGs][iTs][iAs][i$^5$Cs][lT] | 1306 |
| 752 | GAATCTACCCATCCATGTACT | 467 | [x][dt][dc][da][lGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1307 |
| 753 | GAATCTACCATCCATGTACT | 455 | [lGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][iT] | 1308 |
| 754 | GAATCTACCATCCATGTACT | 455 | [iGs][iAs][iAs][iTs][i$^5$Cs][iTs][iAs][i$^5$Cs][i$^5$Cs][iAs][iTs][i$^5$Cs][i$^5$Cs][iAs][iTs][iGs][iTs][iAs][i$^5$Cs][lT] | 1309 |
| 755 | GAATCTACCCATCCATGTACT | 461 | [lGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1310 |
| 756 | GAATCTACCCATCCATGTACT | 461 | [iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1311 |
| 757 | CGAATCTACCCATCCATGTACT | 468 | [l$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1312 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 758 | GAATCTACCCCATCCATGTACT | 469 | [lGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1313 |
| 759 | ACGAATCTACCCATCCATGTACT | 470 | [lAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1314 |
| 760 | CGAATCTACCCCATCCATGTACT | 471 | [l$^5$Cs][iGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1315 |
| 761 | GAATCTACCCCCATCCATGTACT | 472 | [lGs][iAs][iAs][iTs][i$^5$Cs][iTs][iAs][i$^5$Cs][i$^5$Cs][i$^5$Cs][l$^5$Cs][i$^5$Cs][iAs][iTs][i$^5$Cs][i$^5$Cs][iAs][iTs][iGs][iTs][iAs][i$^5$Cs][lT] | 1316 |
| 762 | CACGAATCTACCCATCCATGTACT | 115 | [l$^5$Cs][iAs][i$^5$Cs][iGs][iAs][iAs][iTs][i$^5$Cs][iTs][iAs][i$^5$Cs][i$^5$Cs][i$^5$Cs][iAs][iTs][i$^5$Cs][i$^5$Cs][iAs][iTs][iGs][iTs][iAs][iC][lT] | 1317 |
| 763 | CGAATCTACCCCCATCCATGTACT | 473 | [l$^5$Cs][iGs][iAs][iAs][iTs][i$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][i$^5$C][lT] | 1318 |
| 764 | GAATCTACCCACCATCCATGTACT | 474 | [lGs][iAs][iAs][iTs][i$^5$Cs][iTs][iAs][i$^5$Cs][l$^5$Cs][l$^5$Cs][iAs][l$^5$Cs][i$^5$Cs][iAs][iTs][i$^5$Cs][i$^5$Cs][iAs][iTs][iGs][iTs][iAs][i$^5$C][lT] | 1319 |
| 765 | CGAATCTACATCCATGTACT | 475 | [l$^5$Cs][iGs][iAs][iAs][iTs][i$^5$Cs][iTs][iAs][i$^5$Cs][iAs][iTs][i$^5$Cs][i$^5$Cs][iAs][iTs][iGs][iTs][iAs][i$^5$Cs][lT] | 1320 |
| 766 | ACGAATCTACATCCATGTAC | 476 | [lAs][i$^5$Cs][iGs][iAs][iAs][iTs][i$^5$Cs][iTs][iAs][i$^5$Cs][iAs][iTs][i$^5$Cs][i$^5$Cs][iAs][iTs][iGs][iTs][iAs][l$^5$C] | 1321 |
| 767 | GAATCTACCCCATCCATGTA | 477 | [lGs][iAs][iAs][iTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][lA] | 1322 |
| 768 | CACGAATCTATCCATGTACT | 478 | [l$^5$Cs][iAs][i$^5$Cs][iGs][iAs][iAs][iTs][i$^5$Cs][iTs][iAs][iTs][l$^5$Cs][i$^5$Cs][iAs][iTs][iGs][iTs][iAs][i$^5$Cs][lT] | 1323 |
| 769 | CACGAATCTAATCCATGTAC | 479 | [l$^5$Cs][iAs][i$^5$Cs][iGs][iAs][iAs][iTs][i$^5$Cs][iTs][iAs][iAs][iTs][i$^5$Cs][i$^5$Cs][iAs][iTs][iGs][iTs][iAs][l$^5$C] | 1324 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 770 | CACGAATCTACATCCATGTA | 480 | [l$^5$Cs][iAs][i$^5$Cs][iGs][iAs][iAs][iTs][i$^5$Cs][iTs][iAs][l$^5$Cs][iAs][iTs][i$^5$Cs][i$^5$Cs][iAs][iTs][iGs][iTs][lA] | 1325 |
| 771 | GAATCTACCCCCATCCATGT | 481 | [lGs][iAs][iAs][iTs][i$^5$Cs][iTs][iAs][i$^5$Cs][l$^5$Cs][l$^5$Cs][i$^5$Cs][i$^5$Cs][iAs][iTs][i$^5$Cs][i$^5$Cs][iAs][iTs][iGs][lT] | 1326 |
| 772 | GAATCTACCATCCATGTACT | 455 | [lGs][iAs][iAs][iTs][i$^5$Cs][iTs][lAs][i$^5$Cs][i$^5$Cs][iAs][iTs][i$^5$Cs][i$^5$Cs][iAs][iTs][iGs][iTs][iAs][i$^5$Cs][lT] | 1327 |
| 773 | GAATCTACCATCCATGTACT | 455 | [iGs][iAs][iAs][iTs][i$^5$Cs][iTs][lAs][i$^5$Cs][l$^5$Cs][iAs][iTs][i$^5$Cs][i$^5$Cs][iAs][iTs][iGs][iTs][iAs][i$^5$Cs][lT] | 1328 |
| 774 | GAATCTACCATCCATGTACT | 455 | [iGs][iAs][iAs][iTs][i$^5$Cs][iTs][iAs][l$^5$Cs][l$^5$Cs][iAs][iTs][i$^5$Cs][i$^5$Cs][iAs][iTs][iGs][iTs][iAs][i$^5$Cs][iT] | 1329 |
| 775 | GAATCTACCATCCATGTACT | 455 | [lGs][iAs][iAs][iTs][i$^5$Cs][iTs][iAs][l$^5$Cs][l$^5$Cs][iAs][iTs][l$^5$Cs][i$^5$Cs][iAs][iTs][iGs][iTs][iAs][i$^5$Cs][iT] | 1330 |
| 776 | GAATCTACCATCCATGTACT | 455 | [iGs][iAs][iAs][iTs][i$^5$Cs][iTs][iAs][l$^5$Cs][i$^5$Cs][iAs][iTs][i$^5$Cs][i$^5$Cs][iAs][iTs][iGs][iTs][iAs][i$^5$Cs][lT] | 1331 |
| 777 | GAATCTACCATCCATGTACT | 455 | [lGs][iAs][iAs][iTs][i$^5$Cs][iTs][iAs][i$^5$Cs][l$^5$Cs][iAs][iTs][l$^5$Cs][i$^5$Cs][iAs][iTs][iGs][iTs][iAs][i$^5$Cs][iT] | 1332 |
| 778 | GAATCTACCATCCATGTACT | 455 | [lGs][iAs][iAs][iTs][i$^5$Cs][iTs][iAs][i$^5$Cs][i$^5$Cs][lAs][iTs][i$^5$Cs][i$^5$Cs][iAs][iTs][iGs][iTs][iAs][i$^5$Cs][iT] | 1333 |
| 779 | GAATCTACCATCCATGTACT | 455 | [iGs][iAs][iAs][iTs][i$^5$Cs][iTs][iAs][i$^5$Cs][i$^5$Cs][lAs][iTs][l$^5$Cs][i$^5$Cs][iAs][iTs][iGs][iTs][iAs][i$^5$Cs][lT] | 1334 |
| 780 | GAATCTACCATCCATGTACT | 455 | [iGs][iAs][iAs][iTs][i$^5$Cs][iTs][iAs][i$^5$Cs][l$^5$Cs][iAs][iTs][l$^5$Cs][i$^5$Cs][iAs][iTs][iGs][iTs][iAs][i$^5$Cs][lT] | 1335 |
| 781 | GAATCTACCCATCCATGTACT | 461 | [lGs][iAs][iAs][iTs][i$^5$Cs][iTs][lAs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1336 |

TABLE 11-continued

Exemplary antisense oligonucleotides

| ASO # | Nucleobase Sequence (5' → 3') | SEQ ID NO: | Antisense Oligonucleotide Structures (5' → 3') | SEQ ID NO: |
|---|---|---|---|---|
| 782 | GAATCTACCCATCCATGTACT | 461 | [iGs][iAs][iAs][iTs][i$^5$Cs][iTs][lAs][i$^5$Cs][i$^5$Cs][i$^5$Cs][iAs][iTs][i$^5$Cs][i$^5$Cs][iAs][iTs][iGs][iTs][iAs][i$^5$Cs][iT] | 1337 |
| 783 | GAATCTACCCATCCATGTACT | 461 | [iGs][iAs][iAs][iTs][i$^5$Cs][iTs][iAs][l$^5$Cs][l$^5$Cs][i$^5$Cs][iAs][iTs][i$^5$Cs][i$^5$Cs][iAs][iTs][iGs][iTs][iAs][i$^5$Cs][iT] | 1338 |
| 784 | GAATCTACCCATCCATGTACT | 461 | [lGs][iAs][iAs][iTs][i$^5$Cs][iTs][iAs][l$^5$Cs][i$^5$Cs][i$^5$Cs][iAs][iTs][i$^5$Cs][i$^5$Cs][iAs][iTs][iGs][iTs][iAs][i$^5$Cs][iT] | 1339 |
| 785 | GAATCTACCCATCCATGTACT | 461 | [lGs][iAs][iAs][iTs][i$^5$Cs][iTs][iAs][i$^5$Cs][l$^5$Cs][i$^5$Cs][iAs][iTs][i$^5$Cs][i$^5$Cs][iAs][iTs][iGs][iTs][iAs][i$^5$Cs][iT] | 1340 |
| 786 | GAATCTACCCATCCATGTACT | 461 | [iGs][iAs][iAs][iTs][i$^5$Cs][iTs][iAs][i$^5$Cs][l$^5$Cs][i$^5$Cs][iAs][iTs][i$^5$Cs][i$^5$Cs][iAs][iTs][iGs][lTs][iAs][i$^5$Cs][lT] | 1341 |
| 787 | GAATCTACCCATCCATGTACT | 461 | [iGs][iAs][iAs][iTs][i$^5$Cs][iTs][iAs][l$^5$Cs][i$^5$Cs][i$^5$Cs][iAs][iTs][i$^5$Cs][i$^5$Cs][iAs][iTs][iGs][iTs][iAs][i$^5$Cs][lT] | 1342 |
| 788 | GAATCTACACATCCATGTACT | 482 | [iGs][iAs][iAs][iTs][i$^5$Cs][iTs][iAs][i$^5$Cs][lAs][l$^5$Cs][iAs][iTs][i$^5$Cs][i$^5$Cs][iAs][iTs][iGs][iTs][iAs][i$^5$Cs][iT] | 1343 |
| 789 | GAATCTACACATCCATGTACT | 482 | [lGs][iAs][iAs][iTs][i$^5$Cs][iTs][iAs][i$^5$Cs][lAs][i$^5$Cs][iAs][iTs][i$^5$Cs][i$^5$Cs][iAs][iTs][iGs][iTs][iAs][i$^5$Cs][iT] | 1344 |
| 790 | GAATCTACACATCCATGTACT | 482 | [iGs][iAs][iAs][iTs][i$^5$Cs][iTs][iAs][i$^5$Cs][iAs][l$^5$Cs][iAs][iTs][i$^5$Cs][i$^5$Cs][iAs][iTs][iGs][iTs][iAs][i$^5$Cs][lT] | 1345 |
| 791 | GAATCTACACATCCATGTACT | 482 | [iGs][iAs][iAs][iTs][i$^5$Cs][iTs][iAs][i$^5$Cs][lAs][i$^5$Cs][iAs][iTs][i$^5$Cs][i$^5$Cs][iAs][iTs][iGs][iTs][iAs][i$^5$Cs][iT] | 1346 |
| 792 | GAATCTACCCATCCATGTACT | 461 | [lGs][iAs][iAs][iTs][i$^5$Cs][iTs][iAs][i$^5$Cs][i$^5$Cs][l$^5$Cs][iAs][iTs][i$^5$Cs][i$^5$Cs][iAs][iTs][iGs][iTs][iAs][i$^5$Cs][iT] | 1347 |
| 793 | GAATCTACCCATCCATGTACT | 461 | [lGs][iAs][iAs][iTs][i$^5$Cs][iTs][iAs][i$^5$Cs][i$^5$Cs][l$^5$Cs][lAs][iTs][i$^5$Cs][i$^5$Cs][iAs][iTs][iGs][iTs][i$^5$Cs][iT] | 1348 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 794 | GAATCTACCCATCCATGTACT | 461 | [iGs][iAs][iAs][iTs][i$^5$Cs][iTs][iAs][i$^5$Cs][i$^5$Cs][i$^5$Cs][lAs][iTs][i$^5$Cs][i$^5$Cs][iAs][iTs][iGs][lTs][iAs][i$^5$Cs][lT] | 1349 |
| 795 | GAATCTACCCATCCATGTACT | 461 | [iGs][iAs][iAs][iTs][i$^5$Cs][iTs][iAs][i$^5$Cs][i$^5$Cs][l$^5$Cs][iAs][iTs][i$^5$Cs][i$^5$Cs][iAs][iTs][iGs][iTs][iAs][i$^5$Cs][lT] | 1350 |
| 796 | GAATCTA[n3]CCATCCATGTACT | 246 | [lGs][iAs][iAs][iTs][i$^5$Cs][iTs][iAs][n3s][i$^5$Cs][i$^5$Cs][iAs][iTs][i$^5$Cs][i$^5$Cs][iAs][iTs][iGs][iTs][iAs][i$^5$Cs][lT] | 1351 |
| 797 | GAATCTA[n6]CCATCCATGTACT | 246 | [lGs][iAs][iAs][iTs][i$^5$Cs][iTs][iAs][n6s][i$^5$Cs][i$^5$Cs][iAs][iTs][i$^5$Cs][i$^5$Cs][iAs][iTs][iGs][iTs][iAs][i$^5$Cs][lT] | 1351 |
| 798 | GAATCTA[n3]CCCATCCATGTACT | 534 | [lGs][iAs][iAs][iTs][i$^5$Cs][iTs][iAs][n3s][i$^5$Cs][i$^5$Cs][i$^5$Cs][iAs][iTs][i$^5$Cs][i$^5$Cs][iAs][iTs][iGs][iTs][iAs][i$^5$Cs][lT] | 1352 |
| 799 | GAATCTA[n6]CCCATCCATGTACT | 534 | [lGs][iAs][iAs][iTs][i$^5$Cs][iTs][iAs][n6s][i$^5$Cs][i$^5$Cs][i$^5$Cs][iAs][iTs][i$^5$Cs][i$^5$Cs][iAs][iTs][iGs][iTs][iAs][i$^5$Cs][lT] | 1352 |
| 800 | GAATCTACC[n3]ATCCATGTACT | 535 | [lGs][iAs][iAs][iTs][i$^5$Cs][iTs][iAs][i$^5$Cs][i$^5$Cs][n3s][iAs][iTs][i$^5$Cs][i$^5$Cs][iAs][iTs][iGs][iTs | 1353 |
| 801 | GAATCTACC[n6]ATCCATGTACT | 535 | [lGs][iAs][iAs][iTs][i$^5$Cs][iTs][iAs][i$^5$Cs][i$^5$Cs][n6s][iAs][iTs][i$^5$Cs][i$^5$Cs][iAs][iTs][iGs][iTs][iAs][i$^5$Cs][lT] | 1353 |
| 802 | GAATCTACC[n3]CATCCATGTACT | 264 | [lGs][iAs][iAs][iTs][i$^5$Cs][iTs][iAs][i$^5$Cs][i$^5$Cs][n3s][i$^5$Cs][iAs][iTs][i$^5$Cs][i$^5$Cs][iAs][iTs][iGs][iTs][iAs][i$^5$Cs][lT] | 1354 |
| 803 | GAATCTACC[n6]CATCCATGTACT | 264 | [lGs][iAs][iAs][iTs][i$^5$Cs][iTs][iAs][i$^5$Cs][i$^5$Cs][n6s][l$^5$Cs][iAs][iTs][i$^5$Cs][i$^5$Cs][iAs][iTs][iGs][iTs][iAs][l$^5$Cs][lT] | 1354 |
| 804 | GAATCTAC[n3]CATCCATGTACT | 264 | [lGs][iAs][iAs][iTs][i$^5$Cs][iTs][iAs][i$^5$Cs][n3s][i$^5$Cs][iAs][iTs][i$^5$Cs][i$^5$Cs][iAs][iTs][iGs][iTs][iAs][i$^5$Cs][lT] | 1354 |
| 805 | GAATCTAC[n3]CCATCCATGTACT | 246 | [l$^5$Gs][iAs][iAs][iTs][i$^5$Cs][iTs][iAs][i$^5$Cs][n3s][i$^5$Cs][i$^5$Cs][iAs][iTs][i$^5$Cs][i$^5$Cs][iAs][iTs][iGs][iTs][iAs][i$^5$Cs][lT] | 1351 |

TABLE 11-continued

| Exemplary antisense oligonucleotides | | | | |
|---|---|---|---|---|
| ASO # | Nucleobase Sequence (5' → 3') | SEQ ID NO: | Antisense Oligonucleotide Structures (5' → 3') | SEQ ID NO: |
| 806 | GAATCTAC[n6]CCATCCATGTACT | 246 | [lGs][iAs][iAs][iTs][i$^5$Cs][iTs][iAs][i$^5$Cs][n6s][i$^5$Cs][i$^5$Cs][iAs][iTs][i$^5$Cs][i$^5$Cs][iAs][iTs][iGs][iTs][iAs][i$^5$Cs][lT] | 1351 |
| 807 | GAATCTACCATCCATGTACT | 455 | [lGs][nmaAs][nmaAs][nmaTs][nma$^5$Cs][nmaTs][nmaAs][nma$^5$Cs][nma$^5$Cs][nmaAs][nmaTs][nma$^5$Cs][nma$^5$Cs][nmaAs][nmaTs][nmaGs][nmaTs][nmaAs][nma$^5$Cs][lT] | 1355 |
| 808 | GAATCTACCCATCCATGTACT | 461 | [lGs][nmaAs][nmaAs][nmaTs][nma$^5$Cs][nmaTs][nmaAs][nma$^5$Cs][nma$^5$Cs][nma$^5$Cs][nmaAs][nmaTs][nma$^5$Cs][nma$^5$Cs][nmaAs][nmaTs][nmaGs][nmaTs][nmaAs][nma$^5$Cs][lT] | 1356 |
| 809 | TCTACCCCCATCCATGTACT | 489 | [lTs][l$^5$Cs][iTs][iAs][i$^5$Cs][i$^5$Cs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1357 |
| 810 | ATCTACCCCATCCATGTACT | 490 | [lAs][lTs][i$^5$Cs][iTs][iAs][i$^5$Cs][i$^5$Cs][i$^5$Cs][i$^5$Cs][iAs][iTs][i$^5$Cs][i$^5$Cs][iAs][iTs][iGs][iTs][iAs][l$^5$Cs][lT] | 1358 |
| 811 | GTCGCCGCCATCCATGTACT | 491 | [lGs][lTs][i$^5$Cs][iGs][i$^5$Cs][i$^5$Cs][iGs][i$^5$Cs][i$^5$Cs][iAs][iTs][i$^5$Cs][i$^5$Cs][iAs][iTs][iGs][iTs][iAs][l$^5$Cs][lT] | 1359 |
| 812 | GGGGTCGCCATCCATGTACT | 492 | [lGs][lGs][iGs][iGs][iTs][i$^5$Cs][iGs][i$^5$Cs][i$^5$Cs][iAs][iTs][i$^5$Cs][i$^5$Cs][iAs][iTs][iGs][iTs][iAs][l$^5$Cs][lT] | 1360 |
| 813 | GGGTCGCCCATCCATGTACT | 493 | [lGs][lGs][iGs][iTs][i$^5$Cs][iGs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1361 |
| 814 | GGTCGCCCCATCCATGTACT | 494 | [lGs][lGs][iTs][i$^5$Cs][iGs][i$^5$Cs][i$^5$Cs][i$^5$Cs][i$^5$Cs][iAs][iTs][i$^5$Cs][i$^5$Cs][iAs][iTs][iGs][iTs][iAs][i$^5$Cs][lT] | 1362 |

iA, iG, i$^5$C, and iT are 2'-O-methoxyethyl (2'-MOE) modified adenosine, guanosine, 5'-methyl cytidine, and thymidine, respectively; lA, lG, l$^5$C, and lT are 2'-4'methylene bridge (LNA) modified adenosine, guanosine, 5'-methyl cytidine, and thymidine, respectively; nmaA, nmaG, nma5C, and nmaT are 2'O-NMA modified adenosine, guanosine, 5'-methyl cytidine, and thymidine, respectively; s is a phosphorothioate internucleoside linkage, and the absence of s between two nucleosides indicate a phosphodiester internucleoside linkage; ena is ENA; b is BNA(NC), wherein R is Me; z is AmNA, wherein R is Me; scp is scpBNA; [dt][dc][da] is a phosphodiester DNA "d(TCA)" linker; n3 is a C3 spacer as shown in Table 16; n6 is a C6 spacer as shown in Table 16; and x is a C16 lipid, 6-[(1-oxohexadecyl)amino]hexyl]phosphoryl.

†Each 5'-methyl cytidine ($^5$C) in any of the sequences provided in Table 5 may independently and optionally be replaced with cytidine.

Secondary Structures

The term "secondary structures" as used herein conforms to its generally known meaning, i.e. stems or loops. In some embodiments, pharmaceutically secondary structures include, but are not limited to, hairpin, bulge, helix, internal loop (or interior loop), external loop (or exterior loop), multi-branched loop and pseudoknot. In some embodiment, the antisense oligonucleotide may induce a secondary structure between the first target region and the second target region in the UNC13A pre-mRNA. In some embodiment, the antisense oligonucleotide may induce a secondary structure between the first target region and the second target region in the UNC13A pre-mRNA by simultaneously binding to the first target region and the second target region. In some embodiment, a secondary structure induced by the oligonucleotide may inhibit inclusion of an UNC13A cryptic exon into an UNC13A mature mRNA. In some embodiment, a secondary structure induced by the oligonucleotide may restore UNC13A expression.

Salts

The term "salts" as used herein conforms to its generally known meaning, i.e. an ionic assembly of anions and cations. In some embodiments, the antisense oligonucleotide may be in the form of a pharmaceutically acceptable salt. In some embodiments, pharmaceutically acceptable salts comprise inorganic salts, such as monovalent or divalent inorganic salts. In some embodiments, pharmaceutically acceptable salts include, but are not limited to, sodium, potassium, calcium, magnesium, and ammonium salts. In some embodiments, the pharmaceutically acceptable salt is a sodium salt. In some embodiments, the pharmaceutically acceptable salt is a potassium salt. In some embodiments, the pharmaceutically acceptable salt is a calcium salt. In some embodiments, the pharmaceutically acceptable salt is a magnesium salt. In some embodiments, the pharmaceutically acceptable salt is an ammonium salt. In some embodiments the ammonium salt is represented by the formula: $N(R)_3$, wherein each R is H or an alkyl having from 1 to 6 carbon atoms.

Pharmaceutical Compositions

Pharmaceutical compositions comprising one or more antisense oligonucleotides, either alone or in combination with prophylactic agents, therapeutic agents, and/or pharmaceutically acceptable carriers are provided. The pharmaceutical compositions comprising antisense oligonucleotides provided herein are for use in, but not limited to, diagnosing, detecting, or monitoring a disease, in preventing, treating, managing, or ameliorating a disease or one or more symptoms thereof, and/or in research. In some embodiments, a pharmaceutical composition may further comprise any other suitable therapeutic agent for treatment of a subject, e.g., a human subject having an UNC13A-associated disease (e.g., ALS, FTD, Alzheimer's disease, or LATE). In some embodiments, the other therapeutic agents may enhance or supplement the effectiveness of the complexes disclosed herein. In some embodiments, the subject has decreased expression of TDP-43 gene or protein. In some embodiments, the subject has decreased expression of TDP-43 gene or protein by at least 10%, 20%, 30%, 40%, 50%, 60%, 70%, 80%, 90%, 95% or 100%. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the SOD-1 gene mutation comprises intronic. p.Ala5Val, p.Ala5Thr, p.Leu39Val, p.Gly42Ser, p.His44Arg, p.Leu85Val, p.Gly94Ala, p.Leu107Val, p.Val149Gly, p.Ala141Gly, p.Ala146Thr, p.Ala5Ser, p.Ala5Thr, p.Ala5Val, p.Ala90Thr, p.Ala90Val, p.Arg116Gly, p.Asn87Ser, p.Asp102Gly, p.Asp125Val, p.Asp91Ala, p.Gln23Leu, p.Glu101Gly, p.Glu101Lys, p.Glu50Lys, p.Gly13Arg, p.Gly148Ser, p.Gly38Arg, p.Gly42Asp, p.Gly42Ser, p.Gly94Ala, p.Gly94Arg, p.Gly94Asp, p.Gly94Cys, p.Gly94Ser, p.His121Gln, p.His44Arg, p.His47Arg, p.Ile113Thr, p.Ile114Thr, p.Ile150Thr, p.Leu127Ser, p.Leu145Phe, p.Leu145Ser, p.Leu39Val, p.Leu85Phe, p.Phe21Ile, p.Phe65Leu, p.Thr138Ile, p. Val149Gly or any combination thereof. In some embodiments, the SOD-1 gene mutation comprises intronic, p.Ala5Val, p.Ala5Thr, p.Leu39Val, p.Gly42Ser, p.His44Arg, p.Leu85Val, p.Gly94Ala, p.Leu107Val, p.Val149Gly, p.Ala146Thr, p.Ala5Ser, p.Ala5Thr, p.Ala5Val, p.Ala90Thr, p.Asn87Ser, p.Asp102Gly, p.Gly13Arg, p.Gly42Ser, p.Gly94Ala, p.Gly94Arg, p.His121Gln, p.His44Arg, p.Ile150Thr, p.Leu39Val, p.Leu85Phe, p.Thr138Ile, p. Val149Gly or any combination thereof. In some embodiments, the SOD-1 gene mutation comprises p.Ala5Val, p.Ala5Thr, p.Leu39Val, p.Gly42Ser, p.His44Arg, p.Leu85Val, p.Gly94Ala, p.Leu107Val, p.Val149Gly or any combination thereof. In some embodiments, the subject possesses an UNC13A gene mutation in intron 20. In some embodiments, the UNC13A gene mutation comprises rs12608932, rs12973192, rs56041637, rs116169349, rs62121687, or any combination thereof.

An aspect of the disclosure includes pharmaceutical compositions comprising any one of the antisense oligonucleotides disclosed herein. In some embodiments, the pharmaceutical composition comprises any one of the antisense oligonucleotides disclosed herein and a pharmaceutically acceptable carrier. The pharmaceutical compositions disclosed herein are formulated for administration to a subject. In some embodiments, formulations as disclosed herein comprise an excipient. In some embodiments, an excipient confers to a composition improved stability, improved absorption, improved solubility and/or (e.g., and) therapeutic enhancement of the active ingredient. In some embodiments, an excipient is a pH modifier (e.g., sodium citrate, sodium phosphate, a tris base, or sodium hydroxide), a vehicle (e.g., a buffered solution, petrolatum, dimethyl sulfoxide, or mineral oil), a tonicity agent (e.g., sodium chloride, calcium chloride, magnesium chloride, potassium chloride, dextrose or sucrose or D-mannitol), a solubilizing agent (e.g., polysorbate, cyclodextrin), a binder, a disintegrant or a lubricant. Any one of the disclosed antisense oligonucleotides, when added to pharmaceutically acceptable excipients, can be packaged into kits, containers, packs, or dispensers. The pharmaceutical compositions disclosed herein can be packaged in pre-filled syringes or vials. In some embodiments, such carriers enable pharmaceutical compositions to be formulated as, for example, tablets, pills, dragees, capsules, liquids, gels, syrups, slurries, suspension and lozenges for the oral ingestion by a subject. In some embodiments, a pharmaceutically acceptable carrier or diluent is sterile water, sterile saline, sterile buffer solution or sterile artificial cerebrospinal fluid.

In some embodiments, the delivery vehicle can be used to deliver an antisense oligonucleotide to a cell or tissue. A delivery vehicle is a compound that improves delivery of an antisense oligonucleotide to a cell or tissue. A delivery vehicle can include, or consist of, but is not limited to a polymer, such as an amphipathic polymer, a membrane active polymer, a peptide, a melittin peptide, a melittin-like peptide (MLP), an anti-transferrin peptides, an anti-transferrin antibodies, a lipid, a reversibly modified polymer or peptide, or a reversibly modified membrane active polyamine. In some embodiments, any one of the antisense oligonucleotides or pharmaceutical compositions disclosed herein can be combined with lipids, nanoparticles, polymers, liposomes, micelles, DPCs, peptides, antibodies, virus vectors (e.g., AAV vector), or other delivery systems available in the art.

In some embodiments, a pharmaceutical composition is formulated to be compatible with its intended route of administration. Non-limiting examples of routes of administration include intravenous, intramuscular, intraperitoneal, intracerebrospinal, subcutaneous, intra-articular, intrasynovial, intrathecal, or intracerebroventricular routes. In some embodiments, the route of administration is intrathecal, or intracerebroventricular routes. In some embodiments, the route of administration is subcutaneous.

Kits

An aspect of the disclosure includes kits comprising any one of the antisense oligonucleotides disclosed herein or a pharmaceutical composition disclosed herein. In some embodiments, the kit is for treating an UNC13A-associated disease disclosed herein (e.g., ALS, FTD, Alzheimer's disease or LATE). In some embodiments, the kit further comprises an additional agent disclosed herein.

Methods

Some aspects of the present disclosure provide methods for inhibiting inclusion of an UNC13A cryptic exon into an UNC13A mature mRNA in a cell. In some embodiments, a method for inhibiting inclusion of an UNC13A cryptic exon into an UNC13A mature mRNA in a cell comprises contacting the cell with any one of the antisense oligonucleotides disclosed herein or any one of the pharmaceutical compositions disclosed herein, thereby inhibiting inclusion of an UNC13A cryptic exon into an UNC13A mature mRNA in the cell.

Some aspects of the present disclosure provide methods for restoring UNC13A expression (e.g., mRNA level and/or protein level) in a cell. In some embodiments, a method for restoring UNC13A expression comprises contacting the cell with any one of the antisense oligonucleotides disclosed herein or any one of the pharmaceutical compositions disclosed herein, thereby restoring UNC13A expression (e.g., mRNA level and/or protein level) in the cell. In some embodiments, contacting the cell with any one of the antisense oligonucleotides disclosed herein restores the UNC13A expression level (e.g., mRNA level and/or protein level) by at least 10%, 20%, 30%, 40%, 50%, 60%, 70%, 80%, 90%, or 95%, relative to UNC13A expression in cells not contacted with an antisense oligonucleotide. In some embodiments, the cell is in vitro (e.g., in a cell culture). In some embodiments, the cell is in vivo (e.g., in a subject).

The disclosure also provides methods for inhibiting inclusion of an UNC13A cryptic exon into an UNC13A mature mRNA in a cell of a subject. In some embodiments, a method for inhibiting inclusion of an UNC13A cryptic exon into an UNC13A mature mRNA in a cell comprises administering to the subject any one of the antisense oligonucleotides disclosed herein or any one of the pharmaceutical compositions disclosed herein, thereby inhibiting inclusion of an UNC13A cryptic exon into an UNC13A mature mRNA in the cell.

The disclosure also provides methods for restoring UNC13A expression (e.g., mRNA level and/or protein level) in a subject compared to baseline pre-treatment levels. In some embodiments, methods comprise administering to the subject any one of the antisense oligonucleotides disclosed herein or any one of the pharmaceutical compositions disclosed herein. The UNC13A expression level (e.g., mRNA level and/or protein level) in the subject is restored in a cell, group of cells, tissue, blood, and/or other fluid of the subject. In some embodiments, the above-described methods further comprise determining UNC13A expression (e.g., mRNA level and/or protein level) in a sample(s) from the subject (e.g., UNC13A level in a blood or serum sample(s)). The level of UNC13A in a sample may be measured by general methods known in the art.

In some embodiments, in any one of the methods disclosed herein, a subject is non-human primate, or rodent. In some embodiments, a subject is a human. In some embodiments, the subject has decreased expression of TDP-43 gene or protein. In some embodiments, the subject has decreased expression of TDP-43 gene or protein by at least 10%, 20%, 30%, 40%, 50%, 60%, 70%, 80%, 90%, 95% or 100%, relative to expression of TDP-43 in a healthy subject or a subject that does not have an UNC13A-associated disease (e.g., ALS, FTD. Alzheimer's disease, or LATE). In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the SOD-1 gene mutation comprises intronic, p.Ala5Val, p.Ala5Thr, p.Leu39Val, p.Gly42Ser, p.His44Arg, p.Leu85Val, p.Gly94Ala, p.Leu107Val, p.Val149Gly, p.Ala141Gly, p.Ala146Thr, p.Ala5Ser, p.Ala5Thr, p.Ala5Val, p.Ala90Thr, p.Ala90Val, p.Arg116Gly, p.Asn87Ser, p.Asp102Gly, p.Asp125Val, p.Asp91Ala, p.Gln23Leu, p.Glu101Gly, p.Glu101Lys, p.Glu50Lys, p.Gly13Arg, p.Gly148Ser, p.Gly38Arg, p.Gly42Asp, p.Gly42Ser, p.Gly94Ala, p.Gly94Arg, p.Gly94Asp, p.Gly94Cys, p.Gly94Ser, p.His121Gln, p.His44Arg, p.His47Arg, p.Ile113Thr, p.Ile114Thr, p.Ile150Thr, p.Leu127Ser, p.Leu145Phe, p.Leu145Ser, p.Leu39Val, p.Leu85Phe, p.Phe21 Ile, p.Phe65Leu, p.Thr138Ile, p. Val149Gly or any combination thereof. In some embodiments, the SOD-1 gene mutation comprises intronic, p.Ala5Val, p.Ala5Thr, p.Leu39Val, p.Gly42Ser, p.His44Arg, p.Leu85Val, p.Gly94Ala, p.Leu107Val, p.Val149Gly, p.Ala146Thr, p.Ala5Ser, p.Ala5Thr, p.Ala5Val, p.Ala90Thr, p.Asn87Ser, p.Asp102Gly, p.Gly13Arg, p.Gly42Ser, p.Gly94Ala, p.Gly94Arg, p.His121Gln, p.His44Arg, p.Ile150Thr, p.Leu39Val, p.Leu85Phe, p.Thr138Ile, p. Val149Gly or any combination thereof. In some embodiments, the SOD-1 gene mutation comprises p.Ala5Val, p.Ala5Thr, p.Leu39Val, p.Gly42Ser, p.His44Arg, p.Leu85Val, p.Gly94Ala, p.Leu107Val, p.Val149Gly or any combination thereof. In some embodiments, the subject possesses an UNC13A gene mutation in intron 20. In some embodiments, the UNC13A gene mutation comprises rs12608932, rs12973192, rs56041637, rs116169349, rs62121687, or any combination thereof. In some embodiments, a subject is a patient, e.g., a human patient that has or is suspected of having a disease. In some embodiments, the subject is a human patient who has or is suspected of having an UNC13A-associated disease and/or a disease associated with TDP-43 dysfunction in the subject. In some embodiments, the UNC13A-associated disease and/or a disease associated with TDP-43 dysfunction in the subject is a neurodegenerative disease. In some embodiments, the neurodegenerative disease is ALS or FTD. In some embodiments, the neurodegenerative disease is Alzheimer's disease. In some embodiments, the neurodegenerative disease is LATE. In some embodiments, the neurodegenerative disease is frontotemporal lobar degeneration (FTLD), Progressive supranuclear palsy (PSP), Primary lateral sclerosis (PLS), Progressive muscular atrophy (PMA), facial onset sensory and motor neuronopathy (FOSMN), cerebral age-related TDP-43 with sclerosis (CARTS), Parkinsons disease, Guam Parkinson-dementia complex (G-PDC), Multisystem proteinopathy (MSP), chronic traumatic encephalopathy (CTE), Autism, hippocampal sclerosis (HS), Hippocampal sclerosis dementia, Down syndrome, Huntington's disease, multiple sclerosis, Perry disease, peripheral myopathy, polyglutamine diseases (e.g., spinocerebellar ataxia 3, myopathies and Chronic Traumatic Encephalopathy), Rasmussen's encephalitis, attention deficit hyperactivity disorder, autism, central pain syndromes, anxiety or depression.

An aspect of the disclosure includes a method of treating a subject having an UNC13A-associated disease (e.g., a disease associated with abnormal UNC13A expression). In some embodiments, the method comprises administering to the subject any one of the antisense oligonucleotides disclosed herein, or a pharmaceutical composition disclosed herein. In some embodiments the method results in treating the subject having the UNC13A-associated disease (e.g., a disease associated with abnormal UNC13A expression). In some embodiments, the disease is a neurodegenerative disease. In some embodiments, the neurodegenerative disease is ALS. In some embodiments, the neurodegenerative disease is FTD. In some embodiments, the neurodegenerative disease is Alzheimer's disease. In some embodiments, the neurodegenerative disease is LATE. In some embodiments, the neurodegenerative disease is frontotemporal lobar degeneration (FTLD), Progressive supranuclear palsy (PSP), Primary lateral sclerosis (PLS), Progressive muscular atrophy (PMA), facial onset sensory and motor neuronopathy (FOSMN), cerebral age-related TDP-43 with sclerosis (CARTS), Parkinsons disease, Guam Parkinson-dementia complex (G-PDC), Multisystem proteinopathy (MSP), chronic traumatic encephalopathy (CTE), Autism, hippocampal sclerosis (HS), Hippocampal sclerosis dementia, Down syndrome, Huntington's disease, multiple sclerosis, Perry disease, peripheral myopathy, polyglutamine diseases (e.g., spinocerebellar ataxia 3, myopathies and Chronic Traumatic Encephalopathy), Rasmussen's encephalitis, attention deficit hyperactivity disorder, autism, central pain syndromes, anxiety or depression.

An aspect of the disclosure includes a method of treating a subject having a disease associated with TDP-43 dysfunction in the subject. In some embodiments, the subject has decreased expression of TDP-43 gene or protein. In some embodiments, the subject has decreased expression of TDP-43 gene or protein by at least 10%, 20%, 30%, 40%, 50%, 60%, 70%, 80%, 90%, 95% or 100% relative to expression of TDP-43 in a healthy subject. In some embodiments, the subject has dysfunction of TDP-43 protein. In some embodiments, the subject has cytoplasmic aggregation of TDP-43 protein. In some embodiments, the subject has cytoplasmic mislocalization of TDP-43 protein. In some embodiments, the subject does not possess an SOD-1 gene mutation. In some embodiments, the SOD-1 gene mutation comprises intronic, p.Ala5Val, p.Ala5Thr, p.Leu39Val, p.Gly42Ser, p.His44Arg, p.Leu85Val, p.Gly94Ala, p.Leu107Val, p.Val149Gly, p.Ala141Gly, p.Ala146Thr, p.Ala5Ser, p.Ala5Thr, p.Ala5Val, p.Ala90Thr, p.Ala90Val, p.Arg116Gly, p.Asn87Ser, p.Asp102Gly, p.Asp125Val, p.Asp91Ala, p.Gln23Leu, p.Glu101Gly, p.Glu101Lys, p.Glu50Lys, p.Gly13Arg, p.Gly148Ser, p.Gly38Arg, p.Gly42Asp, p.Gly42Ser, p.Gly94Ala, p.Gly94Arg, p.Gly94Asp, p.Gly94Cys, p.Gly94Ser, p.His121Gln, p.His44Arg, p.His47Arg, p.Ile113Thr, p.Ile114Thr, p.Ile150Thr, p.Leu127Ser, p.Leu145Phe, p.Leu145Ser, p.Leu39Val, p.Leu85Phe, p.Phe21Ile, p.Phe65Leu, p.Thr138Ile, p. Val149Gly or any combination thereof. In some embodiments, the SOD-1 gene mutation comprises intronic, p.Ala5Val, p.Ala5Thr, p.Leu39Val, p.Gly42Ser, p.His44Arg, p.Leu85Val, p.Gly94Ala, p.Leu107Val, p.Val149Gly, p.Ala146Thr, p.Ala5Ser, p.Ala5Thr, p.Ala5Val, p.Ala90Thr, p.Asn87Ser, p.Asp102Gly, p.Gly13Arg, p.Gly42Ser, p.Gly94Ala, p.Gly94Arg, p.His121Gln, p.His44Arg, p.Ile150Thr, p.Leu39Val, p.Leu85Phe, p.Thr138Ile, p. Val149Gly or any combination thereof. In some embodiments, the SOD-1 gene mutation comprises p.Ala5Val, p.Ala5Thr, p.Leu39Val, p.Gly42Ser, p.His44Arg, p.Leu85Val, p.Gly94Ala, p.Leu107Val, p. Val149Gly or any combination thereof. In some embodiments, the subject possesses an UNC13A gene mutation in intron 20. In some embodiments, the UNC13A gene mutation comprises rs12608932, rs12973192, rs56041637, rs116169349, rs62121687, or any combination thereof. In some embodiments, the method comprises administering to the subject any one of the antisense oligonucleotides disclosed herein or a pharmaceutical composition disclosed herein. In some embodiments the method results in treating the subject having a disease associated with TDP-43 dysfunction. In some embodiments, the disease is a neurodegenerative disease. In some embodiments, the neurodegenerative disease is ALS. In some embodiments, the neurodegenerative disease is FTD. In some embodiments, the neurodegenerative disease is Alzheimer's disease. In some embodiments, the neurodegenerative disease is LATE. In some embodiments, the neurodegenerative disease is frontotemporal lobar degeneration (FTLD), Progressive supranuclear palsy (PSP), Primary lateral sclerosis (PLS), Progressive muscular atrophy (PMA), facial onset sensory and motor neuronopathy (FOSMN), cerebral age-related TDP-43 with sclerosis (CARTS), Parkinsons disease, Guam Parkinson-dementia complex (G-PDC), Multisystem proteinopathy (MSP), chronic traumatic encephalopathy (CTE), Autism, hippocampal sclerosis (HS), Hippocampal sclerosis dementia, Down syndrome, Huntington's disease, multiple sclerosis, Perry disease, peripheral myopathy, polyglutamine diseases (e.g., spinocerebellar ataxia 3, myopathies and Chronic Traumatic Encephalopathy), Rasmussen's encephalitis, attention deficit hyperactivity disorder, autism, central pain syndromes, anxiety or depression.

In some embodiments, the above-described methods further comprise administering an additional agent for the treatment of an UNC13A-associated disease (e.g., a disease associated with abnormal UNC13A expression) and/or a disease associated with TDP-43 dysfunction in a subject.

Having now described some embodiments in detail, practice of the invention will be more fully understood from the following examples, which are presented herein for illustration only and should not be construed as limiting the invention in any way.

EXAMPLES

Example 1: Synthesis of Oligonucleotides

The automated solid-support synthesis of 331 oligonucleotides was performed on nS8-II oligonucleotide synthesizer (GeneDesign). Antisense oligonucleotides correspond to ASOs 1-331 and 350-814 in Tables 3, 5, 9, and 11. All the oligonucleotides were synthesized using low-loaded Unylinker™ universal solid support (1 μmol scale, 42.6

μmol/g, ChemGenes, N-4000-10). The protocol for solid-support synthesis is shown in Table 6 below.

TABLE 6

| Step | Reaction | Reagent | Reaction time |
|---|---|---|---|
| 1 | Detritylation | Dichloroacetic Acid-Toluene (3:97) | 90 seconds |
| 2 | Coupling | Activator solution:0.1M Amidite solution = 40:60 (12 eq.) | 300 seconds |
| 3 | Oxidation or Thiolation | Iodine Solution (abt. 0.05 mol/L)][Pyridine:Water(9:1) (for oxidation) or 0.1M ((dimethylamino-methylidene)amino)-3H-1,2,4-dithiazaoline-3-thione in pyridine (for thiolation) | 30 seconds (for oxidation) or 400 seconds (for thiolation) |
| 4 | Capping | 1-Methylimidazole-Acetonitrile (2:8) + Acetic Anhydride-2,6-Lutidine-Acetonitrile (2:3:5) | 90 seconds |

At the end of the solid phase synthesis, cyanoethyl protecting groups were removed by a 10 minute treatment with 10% diethylamine in acetonitrile. The solid support was dried with an argon gas flush and placed into a 2 mL microtube. 500 μL of concentrated aqueous ammonia was added to the tube and the support was treated for 8 hours at 60° C. As for AmNA (R=Me)-containing oligonucleotides, 500 μL of tert-butylamine-MeOH-water (1/1/2) solution was added to the tube and the support was treated for 7 hours at 65° C. (Masaki Yamagami et. al., 1P-40 Synthesis and Properties of Antisense Oligonucleotides Containing AmNA and GuNA, The 46th International Symposium on Nucleic Acids Chemistry & The 3rd Annual Meeting of Japan Society of Nucleic Acids Chemistry on October 29th). The antisense oligonucleotides were isolated with the cartridge purification system (Glen-Pak™ DNA Purification Cartridge. #60-5200, according to the manual provided) to afford an aqueous solution containing the purified oligonucleotide. For distillation of volatile components, a Thermo Scientific SAVANT SPD2010 SpeedVac Concentrator was used. Quantification of the antisense oligonucleotides was conducted based on UV absorbance measurement on Unchaind Labs LUNATIC. Oligonucleotides were analyzed by a Waters Xevo G2-XS Qtof UPLC-MS system (ESI-Qtof) with a ACQUITY UPLC OST C18 (1.7 μm, 2.1×50 mm) column. The eluent was 240 mM hexafluoroisopropanol/7 mM triethylamine aqueous solution containing 5% MeOH and the methanolic solution (100% MeOH). The sample was lyophilized to afford a white powder. Measured molecular weights by mass spectrometry confirmed the molecular weight of the antisense oligonucleotides. A subset of the antisense oligonucleotides was selected for testing in Example 2.

Alternative Method for Synthesis of Oligonucleotides

The automated solid-support synthesis of oligonucleotides was performed on nS8-II oligonucleotide synthesizer (GeneDesign). All the oligonucleotides were synthesized using low-loaded Unylinker™ universal solid support (1.5 μmol scale, 42.6 μmol/g. ChemGenes, N-4000-10). The detailed protocol for nS8-II is shown in Table 7 below.

TABLE 7

| Step | Reaction | Reagent | Reaction time |
|---|---|---|---|
| 1 | Detritylation | Dichloroacetic Acid-Toluene (3:97) | 90 sec |
| 2 | Coupling | Activator solution:0.1M Amidite solution = 40:60 (12 eq.) | 300 sec |
| 3 | Oxidation or Thiolation | Iodine Solution (abt. 0.05 mol/L) Pyridine:Water(9:1) (for oxidation) or 0.1M ((dimethylamino-methylidene)amino)-3H-1,2,4-dithiazaoline-3-thione in pyridine (for thiolation) | 30 seconds (for oxidation) or 400 seconds (for thiolation) |
| 4 | Capping | 1-Methylimidazole-Acetonitrile (2:8) + Acetic Anhydride-2,6-Lutidine-Acetonitrile (2:3:5) | 90 sec |

At the end of the solid phase synthesis, cyanoethyl protecting groups were removed by a 10 minute treatment with 10% diethylamine in acetonitrile. The synthesis was repeated three times on a 1.5 μmol scale, and those were combined into one, resulting in a total of 4.5 μmol scale. The subsequent experiment was then carried out using this combined amount. The solid support was dried with an argon gas flush and placed into a 2 mL microtube. 500 μL of conc. Aq. ammonia was added to the tube and the support was treated for 8 hours at 60° C. Oligonucleotides were isolated with the cartridge purification system (Glen-Pak™ DNA Purification Cartridge, #60-5200, according to the manual provided) to afford aqueous solution containing the purified oligonucleotide. For distillation of volatile components, a Thermo Scientific SAVANT SPD2010 SpeedVac Concentrator was used. The resulting solution was filtered through a 0.20 μm filter (ADVANTEC, DISMIC: 13CP020AS). UV absorbance of the solution was measured and then the sample was lyophilyzed to afford a white powder. Oligonucleotides were analyzed for characterization by a Waters Xevo G2-XS Qtof UPLC-MS system (ESI-Qtof) with a ACQUITY UPLC OST C18 (1.7 μm, 2.1×50 mm) column. The eluent was 240 mM hexafluoroisopropanol/7 mM triethylamine aqueous solution containing 5% MeOH and the methanolic solution (100% MeOH). The data represents the calculated values obtained through deconvolution processing using Waters MassLynx, such as MaxEnt1 because the mass spectrum was observed not as molecular ion peaks, but as multivalent ions. Quantification of oligonucleotides was conducted based on UV absorbance measurement on Unchaind Labs LUNATIC. Measured molecular weights by mass spectrometry confirmed the molecular weight of the antisense oligonucleotides.

Synthesis of 2'-O-NMA-Modified Oligonucleotides

The automated solid-support synthesis of 2'-O-NMA-modified oligonucleotides was performed on nS8-II oligonucleotide synthesizer (GeneDesign). All the oligonucleotides were synthesized using low-loaded Unylinker™ universal solid support (1 μmol scale, 42.6 μmol/g, ChemGenes, N-4000-10). The protocol for solid-support synthesis is shown in Table 17.

TABLE 17

| Step | Reaction | Reagent | Reaction time |
|---|---|---|---|
| 1 | Detritylation | Dichloroacetic Acid-Toluene (3:97) | 90 seconds |
| 2 | Coupling | Activator solution:0.1M Amidite solution = 40:60 (12 eq.) | 300 seconds |
| 3 | Oxidation or Thiolation | Iodine Solution (abt. 0.05 mol/L) Pyridine:Water(9:1) (for oxidation) or 0.1M ((dimethylamino-methylidene)amino)-3H-1,2,4-dithiazaoline-3-thione in pyridine (for thiolation) | 30 seconds (for oxidation) or 400 seconds (for thiolation) |
| 4 | Capping | 1-Methylimidazole-Acetonitrile (2:8) + Acetic Anhydride-2,6-Lutidine-Acetonitrile (2:3:5) | 90 seconds |

At the end of the solid-phase synthesis, cyanoethyl protecting groups were removed by treating the solid support with 10% diethylamine in acetonitrile for 10 minutes. The solid support was then dried using an argon gas flush and transferred into a 2 mL microtube. Next, 500 μL of concentrated aqueous ammonia was added to the tube, and the mixture was incubated at 65° C. for 15 minutes. Subsequently, 500 μL of 40% methylamine was added, and the solution was further incubated for 15 minutes with an aqueous ammonia-to-methylamine ratio of 1:1. Volatile components were removed using a Thermo Scientific SAVANT SPD2010 SpeedVac Concentrator. The resulting solution was filtered through a 0.20 μm filter (ADVANTEC, DISMIC: 13CP020AS) and purified using a C18 reverse-phase column (Xbridge @Oligonucleotide BEH C18, 10 mm×50 mm, 130A, 2.5 um) via HPLC, employing a gradient of 10%-70% of mobile phase B over 30 minutes. Mobile phase A consisted of 240 mM hexafluoroisopropanol and 7 mM triethylamine in an aqueous solution containing 5% methanol, while mobile phase B was 100% methanol. The purified DMT-ON fraction was collected and freeze-dried. The resulting freeze-dried powder was dissolved in 1 mL of distilled water and subjected to detritylation using a cartridge purification system (Glen-Pak™ DNA Purification Cartridge, #60-5200) according to the manufacturer's instructions, yielding an aqueous solution containing the purified oligonucleotide. Volatile components were again removed using the Thermo Scientific SAVANT SPD2010 SpeedVac Concentrator. The final solution was filtered through a 0.20 μm filter (ADVANTEC, DISMIC: 13CP020AS), and its UV absorbance was measured. The purified sample was then lyophilized to afford a white powder. Oligonucleotides were analyzed for characterization by a Waters Xevo G2-XS Qtof UPLC-MS system (ESI-Qtof) with a ACQUITY UPLC OST C18 (1.7 μm, 2.1×50 mm) column. The eluent was 240 mM hexafluoroisopropanol/7 mM triethylamine aqueous solution containing 5% MeOH and the methanolic solution (100% MeOH).

The data represents the calculated values obtained through deconvolution processing using Waters MassLynx, such as MaxEnt1 because the mass spectrum was observed not as molecular ion peaks, but as multivalent ionfragment ions. Quantification of oligonucleotides was conducted based on UV absorbance measurement on Unchaind Labs LUNATIC. Measured molecular weights by mass spectrometry confirmed the molecular weight of the antisense oligonucleotides.

Synthesis of C16-Conjugated Oligonucleotides

Oligonucleotide was chemically synthesized using the deoxynucleoside phosphoramidite approach by AKTA oligopilot plus 10 System. (solid support: UnyLinker™ NittoPhase® 341 μmol/g). 5'-TFA-Amino Modifier C6 CE-Phosphoramidite (Glen research, 10-1916-02) was subjected at the end of coupling cycle. The protocol for solid-support synthesis is shown in Table 18.

TABLE 18

| Step | Reaction | Reagent | Volume | Reaction time |
|---|---|---|---|---|
| 1 | Detritylation | Dichloroacetic Acid-Toluene (3:97) | Until trityl UV disappears | |
| 2 | Coupling | Activator solution:0.1M Amidite solution = 40:60 | 4 eq. | 10 min (for DNA)/20 min (for MOE) |
| 3 | Oxidation or Thiolation | Iodine Solution (abt. 0.05 mol/L)][Pyridine:Water(9:1) (for oxidation) or 0.1M ((dimethylamino-methylidene)amino)-3H-1,2,4-dithiazaoline-3-thione in pyridine (for thiolation) | 3.5 CV (for oxidation) or 3 CV (for thiolation) | 10 min |
| 4 | Capping | 1-Methylimidazole-Acetonitrile (2:8) + Acetic Anhydride-2,6-Lutidine-Acetonitrile (2:3:5) | 2CV | 10 min |

At the end of the solid phase synthesis, cyanoethyl protecting groups were removed by a 10 min treatment with 10% diethylamine in acetonitrile. After transferring the solid phase support from the column reactor to 15 mL Falcon tube, aq. ammonia (4 mL) was added to the tube and the support was treated for 8 hours at 60° C. After filtering the reaction solution, nitrogen gas was blown against the filtrate to remove ammonia. The solution was then lyophilized. The residue was dissolved in water (2 mL), and 300 μL of 3 M aq. Sodium acetate solution (pH=7.0) was added to the solution. EtOH was added to the solution, and the resulting white suspension was centrifuged. The supernatant was removed by decantation, and the residue was dissolved in water. Quantification of the antisense oligonucleotides was conducted based on UV absorbance measurement on Unchaind Labs LUNATIC. Oligonucleotides were analyzed for characterization by a Waters Xevo G2-XS Qtof UPLC-MS system (ESI-Qtof) with a ACQUITY UPLC OST C18 (1.7 μm, 2.1×50 mm) column. The eluent was 240 mM hexafluoroisopropanol/7 mM triethylamine aqueous solution containing 5% MeOH and the methanolic solution (100% MeOH). The sample was lyophilized to afford a C6-amino conjugated oligonucleotide without further purification.

The crude C6 amino conjugated oligonucleotide was dissolved with water. N,N-diisopropylethylamine (100 eq.) and palmitic acid N-hydroxysuccinimide ester (10 eq.) dissolved in DMSO was added to the substrate solution. The reaction mixture was incubated at 45 degrees for 10 h. 3 M aq. Sodium acetate solution (pH=7.0) was added to the solution. EtOH was added to the solution, and the resulting white suspension was centrifuged. The supernatant was removed by decantation, and the residue was dissolved in water. The mixture was purified by HPLC (XBridge, OST C18 column, 2.5 μm, 10×50 mm0.1M TEAA in DW/0.1M TEAA in MeCN, 10%-60% for 30 min). The fraction containing the target product was evaporated, and the residue was dissolved in water, and 3M NaOAc aq. was added to the solution for cation exchange. EtOH was added to the solution, and the resulting white suspension was centrifuged. The supernatant was removed by decantation, and the residue was dissolved with water. The solution was then lyophilized to give C16-conjugated oligonucleotide. Oligonucleotides were analyzed for characterization by a Waters Xevo G2-XS Qtof UPLC-MS system (ESI-Qtof) with a ACQUITY UPLC OST C18 (1.7 μm, 2.1×50 mm) column. The eluent was 240 mM hexafluoroisopropanol/7 mM triethylamine aqueous solution containing 5% MeOH and the methanolic solution (100% MeOH).

The data represents the calculated values obtained through deconvolution processing using Waters MassLynx, such as MaxEnt1 because the mass spectrum was observed not as molecular ion peaks, but as multivalent ionfragment ions. Quantification of oligonucleotides was conducted based on UV absorbance measurement on Unchaind Labs LUNATIC. Measured molecular weights by mass spectrometry confirmed the molecular weight of the antisense oligonucleotides.

Example 2: Activities of Antisense Oligonucleotides In Vivo

This example demonstrates that antisense oligonucleotides disclosed herein inhibited inclusion of the cryptic exon (CE) into UNC13A mRNA.

Single stranded Adeno-associated viral vector 9 (ssAAV9) encoding the UNC13A exon20-intron 20-exon 21 sequence and part of the intron 21 sequence with alternative primer binding site upstream and downstream of the UNC13A sequences driven by a human synapsin I promoter (ssAAV9-SYN1-hUNC13A (SEQ ID NO: 328)) was produced by VectorBuilder. SSAAV9-SYN1-hUNC13A (2 μL of $1.0\times10^{13}$ genome copies/mL) was injected into the right dorsal hippocampus of 8-week-old mice. One week later, to knock down the endogenous mouse Tardbp (TDP-43), the mice received an antisense oligonucleotide (2 μL of 2.5 mM) targeting mouse Tardbp (TDP-43) (5'-AAGGCttcatattgtACTTT-3' (SEQ ID NO: 317) (hereinafter referred to as "Tardbp ASO") with a phosphorothioate backbone, lowercase letters indicating deoxyribonucleosides and uppercase letters indicating 2'-O-methoxyethyl-modified nucleosides, and bases of "C" or "c" indicating 5'-methyl cytosine, or Dulbecco's phosphate-buffered saline (DPBS(−)) ((2 μL) (control; Tardbp ASO (−)) by intrahippocampal injection. The antisense oligonucleotides targeting mouse Tardbp were synthesized by Gene Design Co., Ltd. (Osaka, Japan). One-week post-injection, test antisense oligonucleotides (10 μL of 1.0 mM) or DPBS (10 μL) (control; test antisense oligonucleotide(−)) or were intracerebroventricularly injected. Test antisense oligonucleotides correspond to ASOs 1, 2, 8, 9, 14, 16, 17, 80, 144, 145, 149, 164, 193, 194, 214, 220, 222, 235, 238, 276, and 328 in Tables 3 and 5. Mice were euthanized at 14 days post-test antisense oligonucleotides injection and the right dorsal hippocampus was isolated. Total RNA was extracted using QIAzol Lysis Reagent (Qiagen, 79306) and RNeasy Mini Kit (Qiagen, 74106) and was reverse-transcribed with SuperScript IV VILO Master Mix (Invitrogen, 11756050) following the manufacturers' protocol. qPCR was performed with TaqPath qPCR Master Mix, CG (Applied Biosystems, A15297) on the QuantStudio 7 Flex Real-Time PCR System. Expression levels of mouse Tardbp ((TDP-43) and mouse Actb (Actb) were evaluated using Thermofisher TaqMan Gene Expression Assays: Tardbp (TDP-43) (ID: Mm01257504_g1), Actb (ID: Mm00607939_s1). For detecting the splicing of the UNC13A cryptic exon (CE) and normal splicing, the following sequences of primers and probes were synthesized at Integrated DNA technologies (IDT) and were used: UNC13A_CE FWD 5'-3'CCCCGTACCATGTCCAGTACA (SEQ ID NO: 320), UNC13A_CE REV 5'-3'CATTCACCAGCATTTATTCAACAAA (SEQ ID NO: 321), UNC13A_CE Probe 5'-3'/56-FAM/CTGCATGAG/ZEN/CTGCCT/3IABKFQ/; UNC13A minigene_Normal FWD 5'-3'CTCACTAAAGGGAACAAGCGA (SEQ ID NO: 322), UNC13A minigene_Normal REV 5'-3' GTGGAACAGGTTCTCATGC (SEQ ID NO: 323), UNC13A minigene_Normal Probe 5'-3'/56-FAM/CAGTGTGGA/ZEN/GATCAAAGGCGAGGA/3IABKFQ/(SEQ ID NO: 324).

Each target expression level was calculated using the absolute quantification methods. The expression level of mouse Tardbp was normalized by mouse Actb and the expression level of UNC13A cryptic exon (CE) was normalized by minigene-derived normal UNC13A (detected by using UNC13A minigene_Normal primers and probe) expression level. To calculate TDP-43 knock-down level in Tardbp ASO treated group, the average expression value of the control group (Tardbp ASO non-treated and test antisense oligonucleotide non-treated group) were used for the normalization (100%: Tardbp ASO (−), test antisense oligonucleotide(−) group). For the value of UNC13A CE normalized by minigene-derived normal UNC13A, the average expression value of the control group (Tardbp ASO treated and test antisense oligonucleotide non-treated group) were used for the normalization (100%: Tardbp ASO (+) test antisense oligonucleotide(−)). If multiple tests were performed, the average of those values was calculated.

Results are shown in Table 8 below.

TABLE 8

| ASO # | % TDP-43 level in mice that received the Tardbp ASO relative to mice that received DPBS | % inclusion of UNC13A CE in mice treated with the indicated ASO relative to mice treated with DPBS |
|---|---|---|
| 1 (SEQ ID NO: 574) | 38.3 | 60.8 |
| 2 (SEQ ID NO: 571) | 31.0 | 45.5 |

TABLE 8-continued

| ASO # | % TDP-43 level in mice that received the Tardbp ASO relative to mice that received DPBS | % inclusion of UNC13A CE in mice treated with the indicated ASO relative to mice treated with DPBS |
|---|---|---|
| 8 (SEQ ID NO: 580) | 35.4 | 55.2 |
| 9 (SEQ ID NO: 581) | 33.7 | 21.5 |
| 14 (SEQ ID NO: 586) | 38.1 | 57.7 |
| 16 (SEQ ID NO: 588) | 34.9 | 63.0 |
| 17 (SEQ ID NO: 589) | 26.3 | 64.3 |
| 80 (SEQ ID NO: 652) | 30.2 | 47.0 |
| 144 (SEQ ID NO: 716) | 34.6 | 54.6 |
| 145 (SEQ ID NO: 717) | 33.2 | 62.9 |
| 149 (SEQ ID NO: 721) | 34.5 | 47.0 |
| 164 (SEQ ID NO: 736) | 31.7 | 70.0 |
| 193 (SEQ ID NO: 765) | 30.7 | 68.5 |
| 194 (SEQ ID NO: 766) | 34.1 | 42.2 |
| 214 (SEQ ID NO: 786) | 29.0 | 54.4 |
| 220 (SEQ ID NO: 792) | 30.5 | 19.3 |
| 222 (SEQ ID NO: 794) | 32.8 | 54.6 |
| 235 (SEQ ID NO: 807) | 35.1 | 65.7 |
| 238 (SEQ ID NO: 810) | 37.4 | 34.7 |
| 276 (SEQ ID NO: 848) | 31.8 | 53.2 |
| 328 (SEQ ID NO: 900) | 30.7 | 50.5 |

The results show that all antisense oligonucleotides tested in Table 8 showed inhibition of the inclusion of the CE into UNC13A mRNA.

The same experiment was run with additional test antisense oligonucleotides corresponding to ASOs 81, 107, 324, 327, 369, 373, 396, 486, 494, 495, 514, 521, 532, 561, 603, 629, 631, 632, 633, 650, 660, 663, 692, 726, and 328 in Tables 3, 9, 5, 11. Results are shown in Table 12 below.

TABLE 12

| ASO # | % TDP-43 level in mice that received the Tardbp ASO relative to mice that received DPBS | % inclusion of UNC13A CE in mice treated with the indicated ASO relative to mice treated with DPBS | Amount |
|---|---|---|---|
| 81 (SEQ ID NO: 653) | 28.5 | 37.3 | 10 nmol |
| 107 (SEQ ID NO: 679) | 26.4 | 45.1 | 10 nmol |
| 324 (SEQ ID NO: 896) | 27.4 | 40.8 | 10 nmol |
| 327 (SEQ ID NO: 899) | 33.1 | 35.3 | 10 nmol |
| 369 (SEQ ID NO: 923) | 36.7 | 46.8 | 3 nmol |
| 373 (SEQ ID NO: 570) | 30.3 | 21.2 | 10 nmol |
| 396 (SEQ ID NO: 947) | 33.1 | 48.8 | 3 nmol |
| 486 (SEQ ID NO: 1038) | 33.1 | 51.5 | 10 nmol |
| 494 (SEQ ID NO: 1047) | 27.3 | 63.8 | 10 nmol |
| 495 (SEQ ID NO: 1048) | 28.6 | 47.2 | 10 nmol |
| 514 (SEQ ID NO: 1067) | 33.8 | 48.6 | 10 nmol |
| 521 (SEQ ID NO: 1074) | 33.2 | 49.4 | 10 nmol |
| 532 (SEQ ID NO: 1085) | 46.7 | 35.3 | 10 nmol |
| 561 (SEQ ID NO: 1114) | 47.7 | 21.1 | 3 nmol |
| 603 (SEQ ID NO: 1156) | 25.7 | 49.4 | 10 nmol |
| 629 (SEQ ID NO: 1184) | 26.1 | 51.4 | 10 nmol |
| 631 (SEQ ID NO: 1186) | 34.7 | 56.9 | 10 nmol |
| 632 (SEQ ID NO: 1187) | 42.0 | 39.0 | 10 nmol |
| 633 (SEQ ID NO: 1188) | 24.5 | 63.1 | 3 nmol |
| 650 (SEQ ID NO: 1205) | 27.0 | 62.5 | 3 nmol |
| 660 (SEQ ID NO: 1215) | 23.9 | 51.9 | 3 nmol |
| 663 (SEQ ID NO: 1218) | 26.0 | 42.6 | 3 nmol |
| 692 (SEQ ID NO: 1247) | 34.4 | 60.2 | 10 nmol |
| 726 (SEQ ID NO: 1281) | 43.9 | 57.8 | 10 nmol |

The results show that all antisense oligonucleotides tested in Table 12 showed inhibition of the inclusion of the CE into UNC13A mRNA.

Example 3: Activities of Antisense Oligonucleotides In Vivo (hUNC13A BAC Tg Mice)

This example demonstrates that antisense oligonucleotides (ASO) disclosed herein inhibited inclusion of the cryptic exon (CE) into UNC13A mRNA in human UNC13A BAC transgenic (Tg) mouse model. This mouse model was generated as follows by Institute of Immunology Co., Ltd. Following a modified version of the method by Abe et al. (Exp Anim. 2004 53 (4): 311-320. *Establishment of an efficient BAC transgenesis protocol and its application to functional characterization of the mouse Brachyury locus*), human CH17-170L19 BAC clone (BACPAC GENOMICS, INC.) including human UNC13A gene was purified using a plasmid extraction kit, and linearized by reacting with PI-SceI. The linearized DNA was separated in an agarose gel and extracted using electroelution and dialyzed in TE buffer prepared for microinjection. The purified DNA fragments were assessed for high purification without fragmentation by applying them to pulse-field gel and determine the DNA concentration using a NanoDrop spectrophotometer (Thermo Fisher Scientific). Dilute the DNA solution to 0.5 ng/μl and store it at 4° C. until used for injection. For the verification of the Human UNC13A Locus contained in BAC clone, PCR using following primers were conducted: PCR-A FWD 5'-3' GGTCTGCACAGGAGGAAACC (SEQ ID NO: 536), PCR-A REV 5'-3'CCACACGACCCCTCCAGCAG (SEQ ID NO: 537). For the verification of purified BAC clone by PCR with following primers: PCR-B FWD 5'-3' CTACGAGCATGTCATGAAGTTGC (SEQ ID NO: 538), PCR-B REV 5'-3' AAGCCCATTCATTCCTAGTGCTG (SEQ ID NO: 539), PCR-C FWD 5'-3' ACATCCCTCAGAGTGTTGTGTCA (SEQ ID NO: 540), PCR-C REV 5'-3' CCTGGGGAGGAGAATGAGGTAAA (SEQ ID NO: 541). The DNA were injected into the fertilized egg pronucleus of C57BL/6J mice. After injection, the embryos were injected into the one-side of the fallopian tubes of female mice. Genotyping and southern blotting analysis for the F0 mouse were performed by using primers and probes as follows: PCR-1 FWD 5'-3' ACATCCCTCAGAGTGTTGTGTCA (SEQ ID NO: 540), PCR-1 REV 5'-3' CCTGGGGAGGAGAATGAGGTAAA (SEQ ID NO: 541), PCR-2 FWD 5'-3' TCCATTGAAGTGCATGTGTGTAG (SEQ ID NO: 542), PCR-2 REV 5'-3' GGGACCATAAGAGCTAAAGTTGG (SEQ ID NO: 543), PCR-3 FWD 5'-3' GCATTTGAAAGGTCTCAACTGTATT (SEQ ID NO: 544), PCR-3 REV 5'-3' TTGTTGCTGATGAATCTTGTGTG (SEQ ID NO: 545), PCR-4 FWD 5'-3' GGGAATTTATCTGAAGACCAAGC (SEQ ID NO: 546), PCR-4 REV 5'-3' TCAGCTTTTGAATGGAGAATGAA (SEQ ID NO: 547), PCR-5 FWD 5'-3' TACTCTCGCTGTCTCCTTGTGTC (SEQ ID NO: 548), PCR-5 REV 5'-3' ACTGAAAGAGGCTCAGGAACACT (SEQ ID NO: 549), PCR-6 FWD 5'-3' GACAGTGACTACCGCAGTGAAAC (SEQ ID NO: 550), PCR-6 REV 5'-3' CCACAAGAAAATGTGAATTCTGC (SEQ ID NO: 551), PCR-7 FWD 5'-3' AGTGGGCTTAATTTGCATTCATT (SEQ ID NO: 552), PCR-7 REV 5'-3' GCACAGGTATAATCAGACCCACA (SEQ ID NO: 553), PCR-8 FWD 5'-3' GGTTGGAAGAAGCACTGAGAGG (SEQ ID NO: 554), PCR-8 REV 5'-3' AGAAGAAGGGGAAAGTCAGAGGT (SEQ ID NO: 555), PCR-9 FWD 5'-3' AGTTACACCGTCGTCCCTATCAT (SEQ ID NO: 556), PCR-9 REV 5'-3' ATGACCTTGAAGAAGTGGCTTTC (SEQ ID NO: 557), PCR-10 FWD 5'-3' CCTCACAGTTGTAGACCATGGAA (SEQ ID NO: 558), PCR-10 REV 5'-3' CACACCTCCTTCCA-GATGTTGTA (SEQ ID NO: 559), PCR-11 FWD 5'-3' CTACGAGCATGTCATGAAGTTGC (SEQ ID NO: 538), PCR-11 REV 5'-3' AAGCCCATTCATTCCTAGTGCTG (SEQ ID NO: 539), PCR-12 FWD 5'-3' CCCTGTCTCGTGCTCCCTCAGA (SEQ ID NO: 560), PCR-12 REV 5'-3' CATGGGCAAGCAGTGTGTTCTA (SEQ ID NO: 561), PCR-Internal control (mouse Actb) FWD 5'-3' AGAGAGCTCACCATTCACCATCT (SEQ ID NO: 562), REV 5'-3' TCCTAGGCTCTCAAAACAAAACC (SEQ ID NO: 563), Southern blotting Probe 5'-3' AGCCCAGGGTATCCCCATGGCCCGTC-CACACCAGCCTGGCTATGCTAACTCCCAAA CCATGCACCAAGTCTGGCCCCACA-CATCCCCAGCCCAGCCTCCTTCCCAATGTCAG CCTGGGGTTTCTAGATCTAGAGGGAG-GAGAGAAAACTAGGGCTGAAACTGGGCTG AAGT-CATGGTTAGGGATCAAGGTCAGGGTTAGTTCAGC-CATCAAAGATCAGAGGT CAGGGTTAGAATTGGTGT-TAGGCAAAGGGGTCAGTGCTTAGGGCCAAATTG-GAGG TCATTGTCAGGGTTAGG-GAAAGGTCTGGGGCCGGCTCAGTAGGGGAGTA-GGAATC AAGGGAAGCAATCAG-CATCAGGGGCAAGCTGACTGTTTA-GATGGGCAGCAGGGTT G (SEQ ID NO: 564). The F0 mice and subsequent generations were backcrossed with C57BL/6J.

To knock down the endogenous mouse Tardbp (TDP-43), eight to eleven week old mice received a heteroduplex oligonucleotide (10 μL of 2.5 mM) targeting mouse Tardbp (TDP-43) (antisense strand: 5'-ATATGcacgetgattCCTTT-3' (SEQ ID NO: 1363), with phosphorothioate backbone, lowercase letters indicating deoxyribonucleosides, uppercase letters with underlines indicating ENA-modified nucleosides and bases of "C" or "c" indicating 5'-methyl cytosine, complementary strand: 5'-aaaggaatcagegtgcatat-3' (SEQ ID NO: 1364) with phosphate backbone, lowercase letters indicating deoxyribonucleosides and bases of "c" indicating 5'-methyl cytosine (hereinafter referred to as "Tardbp HDO") or 5% dextrose (5% Dex) (10 μL) as vehicle control (Tardbp HDO (−)) by intracerebroventricular (ICV) injection on day 0 and day 7. The antisense strand of Tardbp HDO was synthesized by KNC Laboratories Co., Ltd. (Kobe, Japan). The complementary strand of Tardbp HDO was synthesized by Gene Design Co., Ltd. (Osaka, Japan). On day 1 and day 21, test ASOs (10 μL of 0.3 mM) or DPBS (10 μL) as vehicle control (test ASO (−)) were injected by ICV. Test ASOs correspond to ASOs 211, 372, 391, 392, 393, 394, 395, 511, 564, 565, 658 in Tables 3, 5, 9, and 11. Mice were euthanized at 21 days after the last test ASO injection, and the cerebral cortex and the spinal cord were isolated. Total RNA was extracted using ISOGEN (NipponGene, 319-90211 and QuickGene RNA Tissue Kit (Kurabo, RT-S2) with DNase (QIAGEN, 79254) treatment, and was reverse-transcribed with SuperPrep II Cell Lysis & RT Kit for qPCR (Toyobo, SCQ-401) following the manufacturers' protocol.

qPCR was performed with THUNDERBIRD Probe qPCR Mix (Toyobo, QPS-101) on the Viia7, QuantStudio 7 Flex or QuantStudio 12K Flex Real-Time PCR System (Applied Biosystems). Expression levels of mouse Tardbp (TDP-43) was evaluated using Thermofisher TaqMan Gene Expression Assays: Tardbp (TDP-43) (ID: Mm01257504_g1). For detecting the splicing of the UNC13A cryptic exon (CE) and mouse Rbfox3, the following sequences of primers and probes were synthesized at Integrated DNA technologies (IDT) and were used: UNC13A_CE FWD 5'-3'CCCCGTACCATGTCCAGTACA (SEQ ID NO: 320), UNC13A_CE REV 5'-3'CATTCACCAGCATTTATT-CAACAAA (SEQ ID NO: 321), UNC13A_CE Probe 5'-3'/56-FAM/CTGCATGAG/ZEN/CTGCCT/3IABKFQ/. Rbfox3 FWD 5'-3'CCGCTCGTTAAAAATGATCTCC (SEQ ID NO: 565), Rbfox3 REV 5'-3' CGACTA-CATGTCTCCAACATCC (SEQ ID NO: 566), Rbfox3 Probe 5'-3'/56-FAM/TTCCCGAAT/ZEN/TGCCCGAA-CATTTGC/3IABKFQ/(SEQ ID NO: 567). qPCR protocol was as below: 95° C. for 60 sec, 45 cycles of 95° C. for 15 sec and 60° C. for 60 sec.

Each target expression level was calculated using the absolute quantification methods. The expression level of mouse Tardbp (TDP-43), UNC13A cryptic exon (CE) were normalized by mouse Rbfox3 expression level. To calculate TDP-43 knock-down level in Tardbp HDO treated group, the average expression value of the control group (Tardbp HDO (−) and test ASO (−) group (DPBS only)) were used for the normalization (100%: Tardbp HDO (−) and test ASO (−)). For the value of UNC13A CE normalized by Rbfox3, the average expression value of the control group (Tardbp HDO (+) and test ASO (−) group) were used for the normalization (100%: Tardbp HDO (+) and test ASO (−)).

For statistical analysis, post-hoc analysis was performed for CE expression data of cerebral cortex and spinal cord. Aspin-Welch's test for Tardbp HDO (−) and test ASO (−) group vs. Tardbp HDO (+) and test ASO (−) was performed to confirm the success of the TDP-43 knockdown. Then, Dunnett's multiple comparison test for Tardbp HDO (+) and test ASO (−) group vs. Tardbp HDO (+) and test ASO (+) groups was performed. Test ASOs that showed significant decrease ($p<0.05$) in CE inclusion are shown in Table 13 below.

TABLE 13

| | | Cerebral Cortex | | Spinal cord | |
|---|---|---|---|---|---|
| ASO # | Concentration (nmol) | % of TDP-43 level in mice that received the Tardbp HDO and DPBS relative to mice that received DPBS only (normalized by Rbfox3 level) | % of inclusion of UNC13A CE in mice treated with the Tardbp HDO and indicated ASO relative to mice treated with Tardbp HDO and DPBS (normalized by Rbfox3 level) | % of TDP-43 level in mice that received the Tardbp HDO and DPBS relative to mice that received DPBS only (normalized by Rbfox3 level) | % of inclusion of UNC13A CE in mice treated with Tardbp HDO and indicated ASO relative to mice treated with Tardbp HDO and DPBS (normalized by Rbfox3 level) |
| 211 (SEQ ID NO: 783) | 3 + 3 | 26.6 | 28.1 | 23.1 | 40.4 |
| 372 (SEQ ID NO: 569) | 3 + 3 | 24.1 | 6.7 | 24.9 | 5.7 |
| 391 (SEQ ID NO: 944) | 3 + 3 | 37.5 | 24.6 | 30.5 | 18.5 |
| 392 (SEQ ID NO: 945) | 3 + 3 | 18.0 | 53.1 | 20.1 | 16.8 |

TABLE 13-continued

| ASO # | Concentration (nmol) | Cerebral Cortex: % of TDP-43 level in mice that received the Tardbp HDO and DPBS relative to mice that received DPBS only (normalized by Rbfox3 level) | Cerebral Cortex: % of inclusion of UNC13A CE in mice treated with the Tardbp HDO and indicated ASO relative to mice treated with Tardbp HDO and DPBS (normalized by Rbfox3 level) | Spinal cord: % of TDP-43 level in mice that received the Tardbp HDO and DPBS relative to mice that received DPBS only (normalized by Rbfox3 level) | Spinal cord: % of inclusion of UNC13A CE in mice treated with Tardbp HDO and indicated ASO relative to mice treated with Tardbp HDO and DPBS (normalized by Rbfox3 level) |
|---|---|---|---|---|---|
| 393 (SEQ ID NO: 946) | 3 + 3 | 19.3 | 31.1 | 20.9 | 15.7 |
| 394 (SEQ ID NO: 572) | 3 + 3 | 25.3 | 10.5 | 23.1 | 9.0 |
| 395 (SEQ ID NO: 573) | 3 + 3 | 19.8 | 30.7 | 21.3 | 22.6 |
| 511 (SEQ ID NO: 1064) | 3 + 3 | 33.0 | 47.3 | 29.4 | 43.3 |
| 564 (SEQ ID NO: 1117) | 3 + 3 | 30.1 | 29.7 | 26.4 | 34.5 |
| 565 (SEQ ID NO: 1118) | 3 + 3 | 36.9 | 23.2 | 41.4 | 36.5 |
| 658 (SEQ ID NO: 1213) | 3 + 3 | 24.3 | 44.3 | 23.3 | 41.4 |

Example 4: Activities of Antisense Oligonucleotides In Vitro (shTDP—SH-SY5Y Cells with LNP TF)

SH-SY5Y cell line (Parental SH-SY5Y Cell line from ATCC; CRL-2266, Lot: 58462094) with doxycycline (dox) inducible expression (Tet-on system) of TDP-43 specific shRNA for knock down was generated (hereinafter referred to as shTDP—SH-SY5Y). TurboRFP and microRNA30-adapted short hairpin RNA is expressed under the Tet operator and minimal CMV promoter and rtTA3 is expressed under the UbC promoter. microRNA30-adapted short hairpin RNA sequence is as below: ttgaatgaggcttcagtactttacagaatcgttgcctgcacatcttggaaacacttgctgggattacttcttcaggttaacccaacagaaggct cgagaaggtatattgctgttgacagtgagcgacacactacaattgatatcaaatagtgaagccacagatgtatttgatatcaattgtagtgtg ttgcctactgcctcggaattcaaggggctactttaggagcaattatcttgtttactaaaactgaataccttgctatctctttgatacatttttacaa agctgaattaaaatggtataaattaaatcacttt (SEQ ID NO: 568). shTDP—SH-SY5Y cells were grown in 43.5% DMEM, high glucose, HEPES (Gibco, 12430054), 43.5% Ham's F-12 Nutrient Mix (Gibco, 11765047), 10% Fetal Bovine Serum (Gibco, A31606-01 or Clontech, 631105), 1× MEM NEAA Solution (Gibco, 11140050), 2 mM Sodium Pyruvate (Gibco, 11360070), and 2 μg/mL Blasticidin S HCl (Gibco, A1113903) at 37° C., 5% CO2. To evaluate UNC13A splicing abnormality and its correction by ASOs, around 60% TDP-43 knock-down was induced by treating cells with 4 μg/mL of doxycycline (Clontech, 631311) for 14 days.

Manufacturing Methods (1) A lipid mixture (cationic lipid:DPPC:cholesterol:GM-020=60:10.6:28:1.4, in mole ratio) was dissolved in 90% EtOH/10% RNase-free water to afford an approximately 14.4 mg/mL lipid solution. The cationic lipid was 3-{[4-(dimethylamino) butanoyl]oxy}-2,2-bis{[(9Z)-tetradec-9-enoyloxy]methyl}propyl (9Z)-tetradec-9-enoate, described in WO2019131839, the contents of which, related to cationic lipids, are incorporated herein by reference. The lipid solution and 10 mM Citrate buffer, pH3 were mixed by using the apparatus NanoAssemblr (Precision Nanosystems) at room temperature with a flow rate ratio of 3 mL/min: 9 mL/min to afford a dispersion containing a lipid particle. By using a Slyde-A-Lyzer (molecular weight cutoff: 20k, Thermo Fisher Scientific), the dispersion obtained was dialyzed with water at 4° C. for 1 hour and with 10 mM MES/0.9% NaCl buffer, pH5 for 2 days. Subsequently, filtration was performed with a 0.2 μm syringe filter (IWAKI CO., LTD.) to prepare a composition for nucleic acid introduction, and thereafter the composition was stored at 4° C. The lipid concentration of the composition was analyzed using HPLC and the size was measured using Zetasizer Nano ZS (Malvern Instruments). The results are shown in Table 14.

(2) At culturing day 11 with doxycycline treatment, shTDP—SH-SY5Y cells were seeded at 60,000 viable cells/well in 96-well plate (Corning, 3598). 0.853 mM of the composition of (1) diluted by saline were gently mixed with 2 μM of test compound in equal amount to form a mixed composition, diluted by 1 mM MES, pH 5.5 in saline and/or DPBS(−), and incubated for 10 min at room temperature. The mixed composition was added to the culture media at the final concentration of 50 nM test compound within 30 min after mixing lipid-based nanoparticles and test compound. The cells were harvested on day 14 after doxycycline treatment by using FastLane Cell Multiplex Kit (QIAGEN, 216513) according to the manufacturer's instructions.

TABLE 14

| | Size (nm) | Polydispersity index (PDI) | Cationic lipid concentration |
|---|---|---|---|
| Nanoparticle 1 | 69.1 | 0.065 | 3.73 mM |

qPCRs were run on a QuantStudio™ 7 Flex Real-Time PCR System (Applied Biosystems) or ViiA™ 7 Real-Time PCR System (Applied Biosystems). The experiments were run in duplicate. The following PCR probe assay for UNC13A CE synthesized at Integrated DNA technologies (IDT) were used: UNC13A_CE FWD 5'-3' CCCCGTACCATGTCCAGTACA (SEQ ID NO: 320), UNC13A_CE REV 5'-3' CATTCACCAGCATTTATTCAACAAA (SEQ ID NO: 321), UNC13A_CE Probe 5'-3'/56-FAM/CTGCATGAG/ZEN/CTGCCT/3IABKFQ/. For housekeeping gene GAPDH expression analysis was performed by using Thermofisher® TaqMan Gene Expression Assay Hs99999905_m1. PCR protocol was as below; 50° C. for 30 min, 95° C. for 15 min, 45 cycles of 94° C. for 15 sec and 60° C. for 60 sec.

Relative expression of UNC13A CE was calculated by normalizing to GAPDH expression (deltaCt), then the average expression value of the control group (saline) without ASO treatment were used for the normalization (100%: dox (+) ASO (−)). Test ASOs correspond to ASOs 1-331 and 350-814 in Tables 3, 5, 9, and 11. Results are shown in Table 15 below.

TABLE 15

| ASO # | Relative expression of UNC13A CE |
|---|---|
| 1 (SEQ ID NO: 574) | 25 |
| 2 (SEQ ID NO: 571) | 30 |
| 3 (SEQ ID NO: 575) | 25 |
| 4 (SEQ ID NO: 576) | 96 |
| 5 (SEQ ID NO: 577) | 80 |
| 6 (SEQ ID NO: 578) | 54 |
| 7 (SEQ ID NO: 579) | 46 |
| 8 (SEQ ID NO: 580) | 43 |
| 9 (SEQ ID NO: 581) | 8 |
| 10 (SEQ ID NO: 582) | 52 |
| 11 (SEQ ID NO: 583) | 51 |
| 12 (SEQ ID NO: 584) | 33 |
| 13 (SEQ ID NO: 585) | 62 |
| 14 (SEQ ID NO: 586) | 20 |
| 15 (SEQ ID NO: 587) | 43 |
| 16 (SEQ ID NO: 588) | 14 |
| 17 (SEQ ID NO: 589) | 27 |
| 18 (SEQ ID NO: 590) | 63 |
| 19 (SEQ ID NO: 591) | 52 |
| 20 (SEQ ID NO: 592) | 51 |
| 21 (SEQ ID NO: 593) | 56 |
| 22 (SEQ ID NO: 594) | 28 |
| 23 (SEQ ID NO: 595) | 27 |
| 24 (SEQ ID NO: 596) | 64 |
| 25 (SEQ ID NO: 597) | 57 |
| 26 (SEQ ID NO: 598) | 90 |
| 27 (SEQ ID NO: 599) | 46 |
| 28 (SEQ ID NO: 600) | 72 |
| 29 (SEQ ID NO: 601) | 44 |
| 30 (SEQ ID NO: 602) | 62 |
| 31 (SEQ ID NO: 603) | 41 |
| 32 (SEQ ID NO: 604) | 75 |
| 33 (SEQ ID NO: 605) | 22 |
| 34 (SEQ ID NO: 606) | 5 |
| 35 (SEQ ID NO: 607) | 18 |
| 36 (SEQ ID NO: 608) | 15 |
| 37 (SEQ ID NO: 609) | 31 |
| 38 (SEQ ID NO: 610) | 42 |
| 39 (SEQ ID NO: 611) | 42 |
| 40 (SEQ ID NO: 612) | 22 |
| 41 (SEQ ID NO: 613) | 5 |
| 42 (SEQ ID NO: 614) | 5 |
| 43 (SEQ ID NO: 615) | 2 |
| 44 (SEQ ID NO: 616) | 4 |
| 45 (SEQ ID NO: 617) | 4 |
| 46 (SEQ ID NO: 618) | 3 |
| 47 (SEQ ID NO: 619) | 2 |
| 48 (SEQ ID NO: 620) | 3 |
| 49 (SEQ ID NO: 621) | 5 |
| 50 (SEQ ID NO: 622) | 7 |
| 51 (SEQ ID NO: 623) | 7 |
| 52 (SEQ ID NO: 624) | 7 |
| 53 (SEQ ID NO: 625) | 48 |
| 54 (SEQ ID NO: 626) | 47 |
| 55 (SEQ ID NO: 627) | 65 |
| 56 (SEQ ID NO: 628) | 37 |
| 57 (SEQ ID NO: 629) | 43 |
| 58 (SEQ ID NO: 630) | 36 |
| 59 (SEQ ID NO: 631) | 9 |
| 60 (SEQ ID NO: 632) | 13 |
| 61 (SEQ ID NO: 633) | 76 |
| 62 (SEQ ID NO: 634) | 63 |
| 63 (SEQ ID NO: 635) | 33 |
| 64 (SEQ ID NO: 636) | 27 |
| 65 (SEQ ID NO: 637) | 65 |
| 66 (SEQ ID NO: 638) | 62 |
| 67 (SEQ ID NO: 639) | 42 |
| 68 (SEQ ID NO: 640) | 28 |
| 69 (SEQ ID NO: 641) | 56 |
| 70 (SEQ ID NO: 642) | 49 |

TABLE 15-continued

| ASO # | Relative expression of UNC13A CE |
|---|---|
| 71 (SEQ ID NO: 643) | 59 |
| 72 (SEQ ID NO: 644) | 47 |
| 73 (SEQ ID NO: 645) | 71 |
| 74 (SEQ ID NO: 646) | 74 |
| 75 (SEQ ID NO: 647) | 38 |
| 76 (SEQ ID NO: 648) | 26 |
| 77 (SEQ ID NO: 649) | 31 |
| 78 (SEQ ID NO: 650) | 34 |
| 79 (SEQ ID NO: 651) | 33 |
| 80 (SEQ ID NO: 652) | 25 |
| 81 (SEQ ID NO: 653) | 16 |
| 82 (SEQ ID NO: 654) | 25 |
| 83 (SEQ ID NO: 655) | 23 |
| 84 (SEQ ID NO: 656) | 23 |
| 85 (SEQ ID NO: 657) | 31 |
| 86 (SEQ ID NO: 658) | 18 |
| 87 (SEQ ID NO: 659) | 19 |
| 88 (SEQ ID NO: 660) | 26 |
| 89 (SEQ ID NO: 661) | 30 |
| 90 (SEQ ID NO: 662) | 21 |
| 91 (SEQ ID NO: 663) | 30 |
| 92 (SEQ ID NO: 664) | 36 |
| 93 (SEQ ID NO: 665) | 57 |
| 94 (SEQ ID NO: 666) | 11 |
| 95 (SEQ ID NO: 667) | 16 |
| 96 (SEQ ID NO: 668) | 12 |
| 97 (SEQ ID NO: 669) | 25 |
| 98 (SEQ ID NO: 670) | 8 |
| 99 (SEQ ID NO: 671) | 8 |
| 100 (SEQ ID NO: 672) | 8 |
| 101 (SEQ ID NO: 673) | 5 |
| 102 (SEQ ID NO: 674) | 5 |
| 103 (SEQ ID NO: 675) | 3 |
| 104 (SEQ ID NO: 676) | 7 |
| 105 (SEQ ID NO: 677) | 2 |
| 106 (SEQ ID NO: 678) | 12 |
| 107 (SEQ ID NO: 679) | 24 |
| 108 (SEQ ID NO: 680) | 18 |
| 109 (SEQ ID NO: 681) | 21 |
| 110 (SEQ ID NO: 682) | 38 |
| 111 (SEQ ID NO: 683) | 27 |
| 112 (SEQ ID NO: 684) | 44 |
| 113 (SEQ ID NO: 685) | 5 |
| 114 (SEQ ID NO: 686) | 68 |
| 115 (SEQ ID NO: 687) | 27 |
| 116 (SEQ ID NO: 688) | 32 |
| 117 (SEQ ID NO: 689) | 33 |
| 118 (SEQ ID NO: 690) | 26 |
| 119 (SEQ ID NO: 691) | 16 |
| 120 (SEQ ID NO: 692) | 6 |
| 121 (SEQ ID NO: 693) | 13 |
| 122 (SEQ ID NO: 694) | 31 |
| 123 (SEQ ID NO: 695) | 6 |
| 124 (SEQ ID NO: 696) | 10 |
| 125 (SEQ ID NO: 697) | 38 |
| 126 (SEQ ID NO: 698) | 40 |
| 127 (SEQ ID NO: 699) | 51 |
| 128 (SEQ ID NO: 700) | 48 |
| 129 (SEQ ID NO: 701) | 81 |
| 130 (SEQ ID NO: 702) | 83 |
| 131 (SEQ ID NO: 703) | 34 |
| 132 (SEQ ID NO: 704) | 50 |
| 133 (SEQ ID NO: 705) | 40 |
| 134 (SEQ ID NO: 706) | 36 |
| 135 (SEQ ID NO: 707) | 70 |
| 136 (SEQ ID NO: 708) | 56 |
| 137 (SEQ ID NO: 709) | 25 |
| 138 (SEQ ID NO: 710) | 43 |
| 139 (SEQ ID NO: 711) | 41 |
| 140 (SEQ ID NO: 712) | 69 |
| 141 (SEQ ID NO: 713) | 18 |
| 142 (SEQ ID NO: 714) | 11 |
| 143 (SEQ ID NO: 715) | 47 |
| 144 (SEQ ID NO: 716) | 18 |
| 145 (SEQ ID NO: 717) | 36 |
| 146 (SEQ ID NO: 718) | 7 |

TABLE 15-continued

| ASO # | Relative expression of UNC13A CE |
|---|---|
| 147 (SEQ ID NO: 719) | 11 |
| 148 (SEQ ID NO: 720) | 23 |
| 149 (SEQ ID NO: 721) | 11 |
| 150 (SEQ ID NO: 722) | 27 |
| 151 (SEQ ID NO: 723) | 11 |
| 152 (SEQ ID NO: 724) | 15 |
| 153 (SEQ ID NO: 725) | 14 |
| 154 (SEQ ID NO: 726) | 74 |
| 155 (SEQ ID NO: 727) | 41 |
| 156 (SEQ ID NO: 728) | 65 |
| 157 (SEQ ID NO: 729) | 77 |
| 158 (SEQ ID NO: 730) | 31 |
| 159 (SEQ ID NO: 731) | 24 |
| 160 (SEQ ID NO: 732) | 32 |
| 161 (SEQ ID NO: 733) | 31 |
| 162 (SEQ ID NO: 734) | 28 |
| 163 (SEQ ID NO: 735) | 34 |
| 164 (SEQ ID NO: 736) | 46 |
| 165 (SEQ ID NO: 737) | 41 |
| 166 (SEQ ID NO: 738) | 30 |
| 167 (SEQ ID NO: 739) | 38 |
| 168 (SEQ ID NO: 740) | 96 |
| 169 (SEQ ID NO: 741) | 55 |
| 170 (SEQ ID NO: 742) | 37 |
| 171 (SEQ ID NO: 743) | 19 |
| 172 (SEQ ID NO: 744) | 21 |
| 173 (SEQ ID NO: 745) | 95 |
| 174 (SEQ ID NO: 746) | 95 |
| 175 (SEQ ID NO: 747) | 89 |
| 176 (SEQ ID NO: 748) | 85 |
| 177 (SEQ ID NO: 749) | 91 |
| 178 (SEQ ID NO: 750) | 85 |
| 179 (SEQ ID NO: 751) | 85 |
| 180 (SEQ ID NO: 752) | 95 |
| 181 (SEQ ID NO: 753) | 40 |
| 182 (SEQ ID NO: 754) | 54 |
| 183 (SEQ ID NO: 755) | 54 |
| 184 (SEQ ID NO: 756) | 78 |
| 185 (SEQ ID NO: 757) | 60 |
| 186 (SEQ ID NO: 758) | 20 |
| 187 (SEQ ID NO: 759) | 51 |
| 188 (SEQ ID NO: 760) | 54 |
| 189 (SEQ ID NO: 761) | 61 |
| 190 (SEQ ID NO: 762) | 47 |
| 191 (SEQ ID NO: 763) | 37 |
| 192 (SEQ ID NO: 764) | 35 |
| 193 (SEQ ID NO: 765) | 32 |
| 194 (SEQ ID NO: 766) | 20 |
| 195 (SEQ ID NO: 767) | 48 |
| 196 (SEQ ID NO: 768) | 43 |
| 197 (SEQ ID NO: 769) | 34 |
| 198 (SEQ ID NO: 770) | 47 |
| 199 (SEQ ID NO: 771) | 47 |
| 200 (SEQ ID NO: 772) | 95 |
| 201 (SEQ ID NO: 773) | 97 |
| 202 (SEQ ID NO: 774) | 78 |
| 203 (SEQ ID NO: 775) | 61 |
| 204 (SEQ ID NO: 776) | 74 |
| 205 (SEQ ID NO: 777) | 42 |
| 206 (SEQ ID NO: 778) | 61 |
| 207 (SEQ ID NO: 779) | 58 |
| 208 (SEQ ID NO: 780) | 75 |
| 209 (SEQ ID NO: 781) | 15 |
| 210 (SEQ ID NO: 782) | 43 |
| 211 (SEQ ID NO: 783) | 33 |
| 212 (SEQ ID NO: 784) | 35 |
| 213 (SEQ ID NO: 785) | 32 |
| 214 (SEQ ID NO: 786) | 30 |
| 215 (SEQ ID NO: 787) | 39 |
| 216 (SEQ ID NO: 788) | 24 |
| 217 (SEQ ID NO: 789) | 46 |
| 218 (SEQ ID NO: 790) | 27 |
| 219 (SEQ ID NO: 791) | 26 |
| 220 (SEQ ID NO: 792) | 17 |
| 221 (SEQ ID NO: 793) | 24 |
| 222 (SEQ ID NO: 794) | 27 |

TABLE 15-continued

| ASO # | Relative expression of UNC13A CE |
|---|---|
| 223 (SEQ ID NO: 795) | 25 |
| 224 (SEQ ID NO: 796) | 35 |
| 225 (SEQ ID NO: 797) | 27 |
| 226 (SEQ ID NO: 798) | 29 |
| 227 (SEQ ID NO: 799) | 25 |
| 228 (SEQ ID NO: 800) | 17 |
| 229 (SEQ ID NO: 801) | 27 |
| 230 (SEQ ID NO: 802) | 15 |
| 231 (SEQ ID NO: 803) | 19 |
| 232 (SEQ ID NO: 804) | 33 |
| 233 (SEQ ID NO: 805) | 27 |
| 234 (SEQ ID NO: 806) | 26 |
| 235 (SEQ ID NO: 807) | 13 |
| 236 (SEQ ID NO: 808) | 51 |
| 237 (SEQ ID NO: 809) | 20 |
| 238 (SEQ ID NO: 810) | 17 |
| 239 (SEQ ID NO: 811) | 24 |
| 240 (SEQ ID NO: 812) | 18 |
| 241 (SEQ ID NO: 813) | 22 |
| 242 (SEQ ID NO: 814) | 15 |
| 243 (SEQ ID NO: 815) | 76 |
| 244 (SEQ ID NO: 816) | 64 |
| 245 (SEQ ID NO: 817) | 67 |
| 246 (SEQ ID NO: 818) | 61 |
| 247 (SEQ ID NO: 819) | 58 |
| 248 (SEQ ID NO: 820) | 81 |
| 249 (SEQ ID NO: 821) | 65 |
| 250 (SEQ ID NO: 822) | 75 |
| 251 (SEQ ID NO: 823) | 48 |
| 252 (SEQ ID NO: 824) | 72 |
| 253 (SEQ ID NO: 825) | 43 |
| 254 (SEQ ID NO: 826) | 40 |
| 255 (SEQ ID NO: 827) | 73 |
| 256 (SEQ ID NO: 828) | 87 |
| 257 (SEQ ID NO: 829) | 28 |
| 258 (SEQ ID NO: 830) | 65 |
| 259 (SEQ ID NO: 831) | 96 |
| 260 (SEQ ID NO: 832) | 78 |
| 261 (SEQ ID NO: 833) | 81 |
| 262 (SEQ ID NO: 834) | 45 |
| 263 (SEQ ID NO: 835) | 85 |
| 264 (SEQ ID NO: 836) | 43 |
| 265 (SEQ ID NO: 837) | 82 |
| 266 (SEQ ID NO: 838) | 56 |
| 267 (SEQ ID NO: 839) | 67 |
| 268 (SEQ ID NO: 840) | 98 |
| 269 (SEQ ID NO: 841) | 86 |
| 270 (SEQ ID NO: 842) | 23 |
| 271 (SEQ ID NO: 843) | 11 |
| 272 (SEQ ID NO: 844) | 61 |
| 273 (SEQ ID NO: 845) | 67 |
| 274 (SEQ ID NO: 846) | 88 |
| 275 (SEQ ID NO: 847) | 100 |
| 276 (SEQ ID NO: 848) | 20 |
| 277 (SEQ ID NO: 849) | 20 |
| 278 (SEQ ID NO: 850) | 40 |
| 279 (SEQ ID NO: 851) | 42 |
| 280 (SEQ ID NO: 852) | 36 |
| 281 (SEQ ID NO: 853) | 86 |
| 282 (SEQ ID NO: 854) | 78 |
| 283 (SEQ ID NO: 855) | 106 |
| 284 (SEQ ID NO: 856) | 105 |
| 285 (SEQ ID NO: 857) | 62 |
| 286 (SEQ ID NO: 858) | 27 |
| 287 (SEQ ID NO: 859) | 31 |
| 288 (SEQ ID NO: 860) | 46 |
| 289 (SEQ ID NO: 861) | 73 |
| 290 (SEQ ID NO: 862) | 89 |
| 291 (SEQ ID NO: 863) | 68 |
| 292 (SEQ ID NO: 864) | 18 |
| 293 (SEQ ID NO: 865) | 70 |
| 294 (SEQ ID NO: 866) | 34 |
| 295 (SEQ ID NO: 867) | 16 |
| 296 (SEQ ID NO: 868) | 18 |
| 297 (SEQ ID NO: 869) | 16 |
| 298 (SEQ ID NO: 870) | 77 |

TABLE 15-continued

| ASO # | Relative expression of UNC13A CE |
|---|---|
| 299 (SEQ ID NO: 871) | 21 |
| 300 (SEQ ID NO: 872) | 57 |
| 301 (SEQ ID NO: 873) | 42 |
| 302 (SEQ ID NO: 874) | 41 |
| 303 (SEQ ID NO: 875) | 19 |
| 304 (SEQ ID NO: 876) | 6 |
| 305 (SEQ ID NO: 877) | 29 |
| 306 (SEQ ID NO: 878) | 19 |
| 307 (SEQ ID NO: 879) | 31 |
| 308 (SEQ ID NO: 880) | 3 |
| 309 (SEQ ID NO: 881) | 93 |
| 310 (SEQ ID NO: 882) | 97 |
| 311 (SEQ ID NO: 883) | 99 |
| 312 (SEQ ID NO: 884) | 99 |
| 313 (SEQ ID NO: 885) | 99 |
| 314 (SEQ ID NO: 886) | 59 |
| 315 (SEQ ID NO: 887) | 99 |
| 316 (SEQ ID NO: 888) | 77 |
| 317 (SEQ ID NO: 889) | 12 |
| 318 (SEQ ID NO: 890) | 13 |
| 319 (SEQ ID NO: 891) | 12 |
| 320 (SEQ ID NO: 892) | 17 |
| 321 (SEQ ID NO: 893) | 31 |
| 322 (SEQ ID NO: 894) | 45 |
| 323 (SEQ ID NO: 895) | 28 |
| 324 (SEQ ID NO: 896) | 14 |
| 325 (SEQ ID NO: 897) | 22 |
| 326 (SEQ ID NO: 898) | 100 |
| 327 (SEQ ID NO: 899) | 18 |
| 328 (SEQ ID NO: 900) | 12 |
| 329 (SEQ ID NO: 901) | 21 |
| 330 (SEQ ID NO: 902) | 6 |
| 331 (SEQ ID NO: 903) | 26 |
| 350 (SEQ ID NO: 904) | 12 |
| 351 (SEQ ID NO: 905) | 26 |
| 352 (SEQ ID NO: 906) | 12 |
| 353 (SEQ ID NO: 907) | 18 |
| 354 (SEQ ID NO: 908) | 24 |
| 355 (SEQ ID NO: 909) | 12 |
| 356 (SEQ ID NO: 910) | 16 |
| 357 (SEQ ID NO: 911) | 8 |
| 358 (SEQ ID NO: 912) | 24 |
| 359 (SEQ ID NO: 913) | 32 |
| 360 (SEQ ID NO: 914) | 32 |
| 361 (SEQ ID NO: 915) | 46 |
| 362 (SEQ ID NO: 916) | 41 |
| 363 (SEQ ID NO: 917) | 32 |
| 364 (SEQ ID NO: 918) | 24 |
| 365 (SEQ ID NO: 919) | 13 |
| 366 (SEQ ID NO: 920) | 11 |
| 367 (SEQ ID NO: 921) | 12 |
| 368 (SEQ ID NO: 922) | 10 |
| 369 (SEQ ID NO: 923) | 8 |
| 370 (SEQ ID NO: 924) | 29 |
| 371 (SEQ ID NO: 925) | 23 |
| 372 (SEQ ID NO: 569) | 3 |
| 373 (SEQ ID NO: 570) | 2 |
| 374 (SEQ ID NO: 927) | 3 |
| 375 (SEQ ID NO: 928) | 6 |
| 376 (SEQ ID NO: 929) | 4 |
| 377 (SEQ ID NO: 930) | 3 |
| 378 (SEQ ID NO: 931) | 5 |
| 379 (SEQ ID NO: 932) | 4 |
| 380 (SEQ ID NO: 933) | 4 |
| 381 (SEQ ID NO: 934) | 12 |
| 382 (SEQ ID NO: 935) | 14 |
| 383 (SEQ ID NO: 936) | 10 |
| 384 (SEQ ID NO: 937) | 5 |
| 385 (SEQ ID NO: 938) | 3 |
| 386 (SEQ ID NO: 939) | 4 |
| 387 (SEQ ID NO: 940) | 8 |
| 388 (SEQ ID NO: 941) | 3 |
| 389 (SEQ ID NO: 942) | 23 |
| 390 (SEQ ID NO: 943) | 9 |
| 391 (SEQ ID NO: 944) | 11 |
| 392 (SEQ ID NO: 945) | 12 |

TABLE 15-continued

| ASO # | Relative expression of UNC13A CE |
|---|---|
| 393 (SEQ ID NO: 946) | 8 |
| 394 (SEQ ID NO: 572) | 7 |
| 395 (SEQ ID NO: 573) | 5 |
| 396 (SEQ ID NO: 947) | 14 |
| 397 (SEQ ID NO: 948) | 8 |
| 398 (SEQ ID NO: 949) | 11 |
| 399 (SEQ ID NO: 950) | 15 |
| 400 (SEQ ID NO: 951) | 11 |
| 401 (SEQ ID NO: 952) | 12 |
| 402 (SEQ ID NO: 953) | 13 |
| 403 (SEQ ID NO: 954) | 13 |
| 404 (SEQ ID NO: 955) | 17 |
| 405 (SEQ ID NO: 956) | 16 |
| 406 (SEQ ID NO: 957) | 14 |
| 407 (SEQ ID NO: 958-[n3s]-SEQ ID NO: 959) | 10 |
| 408 (SEQ ID NO: 958-[n6s]-SEQ ID NO: 959) | 12 |
| 409 (SEQ ID NO: 960) | 45 |
| 410 (SEQ ID NO: 961) | 40 |
| 411 (SEQ ID NO: 962) | 12 |
| 412 (SEQ ID NO: 963) | 28 |
| 413 (SEQ ID NO: 964) | 40 |
| 414 (SEQ ID NO: 965) | 20 |
| 415 (SEQ ID NO: 966) | 23 |
| 416 (SEQ ID NO: 967) | 30 |
| 417 (SEQ ID NO: 968) | 7 |
| 418 (SEQ ID NO: 969) | 2 |
| 419 (SEQ ID NO: 970) | 31 |
| 420 (SEQ ID NO: 971-[n6s]-SEQ ID NO: 972) | 14 |
| 421 (SEQ ID NO: 973) | 38 |
| 422 (SEQ ID NO: 974) | 26 |
| 423 (SEQ ID NO: 975) | 16 |
| 424 (SEQ ID NO: 976) | 21 |
| 425 (SEQ ID NO: 977) | 28 |
| 426 (SEQ ID NO: 978) | 12 |
| 427 (SEQ ID NO: 979) | 15 |
| 428 (SEQ ID NO: 980) | 57 |
| 429 (SEQ ID NO: 981) | 51 |
| 430 (SEQ ID NO: 982) | 68 |
| 431 (SEQ ID NO: 983) | 48 |
| 432 (SEQ ID NO: 984) | 56 |
| 433 (SEQ ID NO: 985) | 30 |
| 434 (SEQ ID NO: 986) | 25 |
| 435 (SEQ ID NO: 987) | 25 |
| 436 (SEQ ID NO: 988) | 22 |
| 437 (SEQ ID NO: 989) | 17 |
| 438 (SEQ ID NO: 990) | 16 |
| 439 (SEQ ID NO: 991) | 26 |
| 440 (SEQ ID NO: 992) | 33 |
| 441 (SEQ ID NO: 993) | 36 |
| 442 (SEQ ID NO: 994) | 33 |
| 443 (SEQ ID NO: 995) | 47 |
| 444 (SEQ ID NO: 996) | 62 |
| 445 (SEQ ID NO: 997) | 58 |
| 446 (SEQ ID NO: 998) | 14 |
| 447 (SEQ ID NO: 999) | 24 |
| 448 (SEQ ID NO: 1000) | 51 |
| 449 (SEQ ID NO: 1001) | 33 |
| 450 (SEQ ID NO: 1002) | 37 |
| 451 (SEQ ID NO: 1003) | 28 |
| 452 (SEQ ID NO: 1004) | 31 |
| 453 (SEQ ID NO: 1005) | 38 |
| 454 (SEQ ID NO: 1006) | 29 |
| 455 (SEQ ID NO: 1007) | 36 |
| 456 (SEQ ID NO: 1008) | 40 |
| 457 (SEQ ID NO: 1009) | 23 |
| 458 (SEQ ID NO: 1010) | 31 |
| 459 (SEQ ID NO: 1011) | 63 |
| 460 (SEQ ID NO: 1012) | 61 |
| 461 (SEQ ID NO: 1013) | 54 |
| 462 (SEQ ID NO: 1014) | 68 |
| 463 (SEQ ID NO: 1015) | 14 |
| 464 (SEQ ID NO: 1016) | 8 |
| 465 (SEQ ID NO: 1017) | 18 |
| 466 (SEQ ID NO: 1018) | 8 |
| 467 (SEQ ID NO: 1019) | 4 |
| 468 (SEQ ID NO: 1020) | 18 |

TABLE 15-continued

| ASO # | Relative expression of UNC13A CE |
|---|---|
| 469 (SEQ ID NO: 1021) | 8 |
| 470 (SEQ ID NO: 1022) | 11 |
| 471 (SEQ ID NO: 1023) | 7 |
| 472 (SEQ ID NO: 1024) | 4 |
| 473 (SEQ ID NO: 1025) | 3 |
| 474 (SEQ ID NO: 1026) | 14 |
| 475 (SEQ ID NO: 1027) | 13 |
| 476 (SEQ ID NO: 1028) | 9 |
| 477 (SEQ ID NO: 1029) | 10 |
| 478 (SEQ ID NO: 1030) | 38 |
| 479 (SEQ ID NO: 1031) | 15 |
| 480 (SEQ ID NO: 1032) | 47 |
| 481 (SEQ ID NO: 1033) | 20 |
| 482 (SEQ ID NO: 1034) | 29 |
| 483 (SEQ ID NO: 1035) | 37 |
| 484 (SEQ ID NO: 1036) | 67 |
| 485 (SEQ ID NO: 1037) | 56 |
| 486 (SEQ ID NO: 1038) | 27 |
| 487 (SEQ ID NO: 1039) | 27 |
| 488 (SEQ ID NO: 1040-[n6s]-SEQ ID NO: 1041) | 24 |
| 489 (SEQ ID NO: 1042) | 45 |
| 490 (SEQ ID NO: 1043) | 49 |
| 491 (SEQ ID NO: 1044) | 2 |
| 492 (SEQ ID NO: 1045) | 36 |
| 493 (SEQ ID NO: 1046) | 55 |
| 494 (SEQ ID NO: 1047) | 24 |
| 495 (SEQ ID NO: 1048) | 37 |
| 496 (SEQ ID NO: 1049) | 38 |
| 497 (SEQ ID NO: 1050) | 15 |
| 498 (SEQ ID NO: 1051) | 16 |
| 499 (SEQ ID NO: 1052) | 16 |
| 500 (SEQ ID NO: 1053) | 17 |
| 501 (SEQ ID NO: 1054) | 25 |
| 502 (SEQ ID NO: 1055) | 32 |
| 503 (SEQ ID NO: 1056) | 46 |
| 504 (SEQ ID NO: 1057) | 15 |
| 505 (SEQ ID NO: 1058) | 31 |
| 506 (SEQ ID NO: 1059) | 32 |
| 507 (SEQ ID NO: 1060) | 62 |
| 508 (SEQ ID NO: 1061) | 56 |
| 509 (SEQ ID NO: 1062) | 37 |
| 510 (SEQ ID NO: 1063) | 34 |
| 511 (SEQ ID NO: 1064) | 31 |
| 512 (SEQ ID NO: 1065) | 28 |
| 513 (SEQ ID NO: 1066) | 19 |
| 514 (SEQ ID NO: 1067) | 17 |
| 515 (SEQ ID NO: 1068) | 15 |
| 516 (SEQ ID NO: 1069) | 16 |
| 517 (SEQ ID NO: 1070) | 68 |
| 518 (SEQ ID NO: 1071) | 42 |
| 519 (SEQ ID NO: 1072) | 28 |
| 520 (SEQ ID NO: 1073) | 46 |
| 521 (SEQ ID NO: 1074) | 44 |
| 522 (SEQ ID NO: 1075) | 61 |
| 523 (SEQ ID NO: 1076) | 67 |
| 524 (SEQ ID NO: 1077) | 27 |
| 525 (SEQ ID NO: 1078) | 43 |
| 526 (SEQ ID NO: 1079) | 48 |
| 527 (SEQ ID NO: 1080) | 48 |
| 528 (SEQ ID NO: 1081) | 49 |
| 529 (SEQ ID NO: 1082) | 27 |
| 530 (SEQ ID NO: 1083) | 22 |
| 531 (SEQ ID NO: 1084) | 36 |
| 532 (SEQ ID NO: 1085) | 20 |
| 533 (SEQ ID NO: 1086) | 31 |
| 534 (SEQ ID NO: 1087) | 16 |
| 535 (SEQ ID NO: 1088) | 40 |
| 536 (SEQ ID NO: 1089) | 16 |
| 537 (SEQ ID NO: 1090) | 30 |
| 538 (SEQ ID NO: 1091) | 26 |
| 539 (SEQ ID NO: 1092) | 43 |
| 540 (SEQ ID NO: 1093) | 42 |
| 541 (SEQ ID NO: 1094) | 15 |
| 542 (SEQ ID NO: 1095) | 15 |
| 543 (SEQ ID NO: 1096) | 18 |
| 544 (SEQ ID NO: 1097) | 14 |

TABLE 15-continued

| ASO # | Relative expression of UNC13A CE |
|---|---|
| 545 (SEQ ID NO: 1098) | 22 |
| 546 (SEQ ID NO: 1099) | 15 |
| 547 (SEQ ID NO: 1100) | 18 |
| 548 (SEQ ID NO: 1101) | 26 |
| 549 (SEQ ID NO: 1102) | 15 |
| 550 (SEQ ID NO: 1103) | 18 |
| 551 (SEQ ID NO: 1104) | 11 |
| 552 (SEQ ID NO: 1105) | 6 |
| 553 (SEQ ID NO: 1106) | 8 |
| 554 (SEQ ID NO: 1107) | 20 |
| 555 (SEQ ID NO: 1108) | 19 |
| 556 (SEQ ID NO: 1109) | 29 |
| 557 (SEQ ID NO: 1110) | 14 |
| 558 (SEQ ID NO: 1111) | 15 |
| 559 (SEQ ID NO: 1112) | 16 |
| 560 (SEQ ID NO: 1113) | 20 |
| 561 (SEQ ID NO: 1114) | 23 |
| 562 (SEQ ID NO: 1115) | 19 |
| 563 (SEQ ID NO: 1116) | 20 |
| 564 (SEQ ID NO: 1117) | 27 |
| 565 (SEQ ID NO: 1118) | 42 |
| 566 (SEQ ID NO: 1119) | 36 |
| 567 (SEQ ID NO: 1120) | 55 |
| 568 (SEQ ID NO: 1121) | 47 |
| 569 (SEQ ID NO: 1122) | 46 |
| 570 (SEQ ID NO: 1123) | 59 |
| 571 (SEQ ID NO: 1124) | 69 |
| 572 (SEQ ID NO: 1125) | 51 |
| 573 (SEQ ID NO: 1126) | 54 |
| 574 (SEQ ID NO: 1127) | 65 |
| 575 (SEQ ID NO: 1128) | 69 |
| 576 (SEQ ID NO: 1129) | 49 |
| 577 (SEQ ID NO: 1130) | 36 |
| 578 (SEQ ID NO: 1131) | 62 |
| 579 (SEQ ID NO: 1132) | 28 |
| 580 (SEQ ID NO: 1133) | 35 |
| 581 (SEQ ID NO: 1134) | 69 |
| 582 (SEQ ID NO: 1135) | 36 |
| 583 (SEQ ID NO: 1136) | 45 |
| 584 (SEQ ID NO: 1137) | 58 |
| 585 (SEQ ID NO: 1138) | 21 |
| 586 (SEQ ID NO: 1139) | 20 |
| 587 (SEQ ID NO: 1140) | 10 |
| 588 (SEQ ID NO: 1141) | 38 |
| 589 (SEQ ID NO: 1142) | 40 |
| 590 (SEQ ID NO: 1143) | 31 |
| 591 (SEQ ID NO: 1144) | 29 |
| 592 (SEQ ID NO: 1145) | 12 |
| 593 (SEQ ID NO: 1146) | 6 |
| 594 (SEQ ID NO: 1147) | 5 |
| 595 (SEQ ID NO: 1148) | 38 |
| 596 (SEQ ID NO: 1149) | 11 |
| 597 (SEQ ID NO: 1150) | 11 |
| 598 (SEQ ID NO: 1151) | 42 |
| 599 (SEQ ID NO: 1152) | 36 |
| 600 (SEQ ID NO: 1153) | 35 |
| 601 (SEQ ID NO: 1154) | 27 |
| 602 (SEQ ID NO: 1155) | 27 |
| 603 (SEQ ID NO: 1156) | 16 |
| 604 (SEQ ID NO: 1157) | 13 |
| 605 (SEQ ID NO: 1158) | 11 |
| 606 (SEQ ID NO: 1159) | 19 |
| 607 (SEQ ID NO: 1160) | 26 |
| 608 (SEQ ID NO: 1161) | 22 |
| 609 (SEQ ID NO: 1162) | 28 |
| 610 (SEQ ID NO: 1163) | 22 |
| 611 (SEQ ID NO: 1164) | 36 |
| 612 (SEQ ID NO: 1165) | 35 |
| 613 (SEQ ID NO: 1166-[n3s]-SEQ ID NO: 1167) | 27 |
| 614 (SEQ ID NO: 1168-[n6s]-SEQ ID NO: 1169) | 15 |
| 615 (SEQ ID NO: 1170) | 18 |
| 616 (SEQ ID NO: 1171) | 30 |
| 617 (SEQ ID NO: 1172) | 19 |
| 618 (SEQ ID NO: 1173) | 31 |
| 619 (SEQ ID NO: 1174) | 28 |
| 620 (SEQ ID NO: 1175) | 23 |

TABLE 15-continued

| ASO # | Relative expression of UNC13A CE |
|---|---|
| 621 (SEQ ID NO: 1176) | 23 |
| 622 (SEQ ID NO: 1177) | 20 |
| 623 (SEQ ID NO: 1178) | 26 |
| 624 (SEQ ID NO: 1179) | 22 |
| 625 (SEQ ID NO: 1180) | 26 |
| 626 (SEQ ID NO: 1181) | 19 |
| 627 (SEQ ID NO: 1182) | 41 |
| 628 (SEQ ID NO: 1183) | 41 |
| 629 (SEQ ID NO: 1184) | 23 |
| 630 (SEQ ID NO: 1185) | 37 |
| 631 (SEQ ID NO: 1186) | 27 |
| 632 (SEQ ID NO: 1187) | 12 |
| 633 (SEQ ID NO: 1188) | 17 |
| 634 (SEQ ID NO: 1189) | 21 |
| 635 (SEQ ID NO: 1190) | 37 |
| 636 (SEQ ID NO: 1191) | 20 |
| 637 (SEQ ID NO: 1192) | 20 |
| 638 (SEQ ID NO: 1193) | 25 |
| 639 (SEQ ID NO: 1194) | 23 |
| 640 (SEQ ID NO: 1195) | 21 |
| 641 (SEQ ID NO: 1196) | 22 |
| 642 (SEQ ID NO: 1197) | 26 |
| 643 (SEQ ID NO: 1198) | 26 |
| 644 (SEQ ID NO: 1199) | 31 |
| 645 (SEQ ID NO: 1200) | 17 |
| 646 (SEQ ID NO: 1201) | 19 |
| 647 (SEQ ID NO: 1202) | 7 |
| 648 (SEQ ID NO: 1203) | 9 |
| 649 (SEQ ID NO: 1204) | 18 |
| 650 (SEQ ID NO: 1205) | 16 |
| 651 (SEQ ID NO: 1206) | 32 |
| 652 (SEQ ID NO: 1207) | 19 |
| 653 (SEQ ID NO: 1208) | 10 |
| 654 (SEQ ID NO: 1209) | 11 |
| 655 (SEQ ID NO: 1210) | 13 |
| 656 (SEQ ID NO: 1211) | 7 |
| 657 (SEQ ID NO: 1212) | 8 |
| 658 (SEQ ID NO: 1213) | 8 |
| 659 (SEQ ID NO: 1214) | 10 |
| 660 (SEQ ID NO: 1215) | 21 |
| 661 (SEQ ID NO: 1216) | 15 |
| 662 (SEQ ID NO: 1217) | 9 |
| 663 (SEQ ID NO: 1218) | 24 |
| 664 (SEQ ID NO: 1219) | 9 |
| 665 (SEQ ID NO: 1220) | 7 |
| 666 (SEQ ID NO: 1221) | 5 |
| 667 (SEQ ID NO: 1222) | 6 |
| 668 (SEQ ID NO: 1223) | 7 |
| 669 (SEQ ID NO: 1224) | 14 |
| 670 (SEQ ID NO: 1225) | 14 |
| 671 (SEQ ID NO: 1226) | 20 |
| 672 (SEQ ID NO: 1227) | 27 |
| 673 (SEQ ID NO: 1228) | 15 |
| 674 (SEQ ID NO: 1229) | 27 |
| 675 (SEQ ID NO: 1230) | 27 |
| 676 (SEQ ID NO: 1231) | 20 |
| 677 (SEQ ID NO: 1232) | 14 |
| 678 (SEQ ID NO: 1233) | 16 |
| 679 (SEQ ID NO: 1234) | 22 |
| 680 (SEQ ID NO: 1235) | 19 |
| 681 (SEQ ID NO: 1236) | 13 |
| 682 (SEQ ID NO: 1237) | 28 |
| 683 (SEQ ID NO: 1238) | 13 |
| 684 (SEQ ID NO: 1239) | 18 |
| 685 (SEQ ID NO: 1240) | 21 |
| 686 (SEQ ID NO: 1241) | 26 |
| 687 (SEQ ID NO: 1242) | 21 |
| 688 (SEQ ID NO: 1243) | 40 |
| 689 (SEQ ID NO: 1244) | 34 |
| 690 (SEQ ID NO: 1245) | 21 |
| 691 (SEQ ID NO: 1246) | 23 |
| 692 (SEQ ID NO: 1247) | 19 |
| 693 (SEQ ID NO: 1248) | 29 |
| 694 (SEQ ID NO: 1249) | 14 |
| 695 (SEQ ID NO: 1250) | 18 |
| 696 (SEQ ID NO: 1251) | 32 |

TABLE 15-continued

| ASO # | Relative expression of UNC13A CE |
|---|---|
| 697 (SEQ ID NO: 1252) | 14 |
| 698 (SEQ ID NO: 1253) | 16 |
| 699 (SEQ ID NO: 1254) | 18 |
| 700 (SEQ ID NO: 1255) | 15 |
| 701 (SEQ ID NO: 1256) | 13 |
| 702 (SEQ ID NO: 1257) | 18 |
| 703 (SEQ ID NO: 1258) | 23 |
| 704 (SEQ ID NO: 1259) | 18 |
| 705 (SEQ ID NO: 1260) | 20 |
| 706 (SEQ ID NO: 1261) | 23 |
| 707 (SEQ ID NO: 1262) | 23 |
| 708 (SEQ ID NO: 1263) | 25 |
| 709 (SEQ ID NO: 1264) | 22 |
| 710 (SEQ ID NO: 1265) | 20 |
| 711 (SEQ ID NO: 1266) | 18 |
| 712 (SEQ ID NO: 1267) | 24 |
| 713 (SEQ ID NO: 1268) | 20 |
| 714 (SEQ ID NO: 1269) | 23 |
| 715 (SEQ ID NO: 1270) | 26 |
| 716 (SEQ ID NO: 1271) | 31 |
| 717 (SEQ ID NO: 1272) | 34 |
| 718 (SEQ ID NO: 1273) | 38 |
| 719 (SEQ ID NO: 1274) | 29 |
| 720 (SEQ ID NO: 1275) | 40 |
| 721 (SEQ ID NO: 1276) | 31 |
| 722 (SEQ ID NO: 1277) | 40 |
| 723 (SEQ ID NO: 1278) | 33 |
| 724 (SEQ ID NO: 1279) | 32 |
| 725 (SEQ ID NO: 1280) | 38 |
| 726 (SEQ ID NO: 1281) | 16 |
| 727 (SEQ ID NO: 1282) | 16 |
| 728 (SEQ ID NO: 1283) | 24 |
| 729 (SEQ ID NO: 1284) | 26 |
| 730 (SEQ ID NO: 1285) | 16 |
| 731 (SEQ ID NO: 1286) | 24 |
| 732 (SEQ ID NO: 1287) | 23 |
| 733 (SEQ ID NO: 1288) | 34 |
| 734 (SEQ ID NO: 1289) | 16 |
| 735 (SEQ ID NO: 1290) | 32 |
| 736 (SEQ ID NO: 1291) | 13 |
| 737 (SEQ ID NO: 1292) | 14 |
| 738 (SEQ ID NO: 1293) | 13 |
| 739 (SEQ ID NO: 1294) | 14 |
| 740 (SEQ ID NO: 1295) | 13 |
| 741 (SEQ ID NO: 1296) | 12 |
| 742 (SEQ ID NO: 1297) | 14 |
| 743 (SEQ ID NO: 1298) | 13 |
| 744 (SEQ ID NO: 1299) | 16 |
| 745 (SEQ ID NO: 1300) | 13 |
| 746 (SEQ ID NO: 1301) | 18 |
| 747 (SEQ ID NO: 1302) | 17 |
| 748 (SEQ ID NO: 1303) | 22 |
| 749 (SEQ ID NO: 1304) | 19 |
| 750 (SEQ ID NO: 1305) | 14 |
| 751 (SEQ ID NO: 1306) | 16 |
| 752 (SEQ ID NO: 1307) | 18 |
| 753 (SEQ ID NO: 1308) | 19 |
| 754 (SEQ ID NO: 1309) | 25 |
| 755 (SEQ ID NO: 1310) | 22 |
| 756 (SEQ ID NO: 1311) | 28 |
| 757 (SEQ ID NO: 1312) | 24 |
| 758 (SEQ ID NO: 1313) | 34 |
| 759 (SEQ ID NO: 1314) | 25 |
| 760 (SEQ ID NO: 1315) | 23 |
| 761 (SEQ ID NO: 1316) | 27 |
| 762 (SEQ ID NO: 1317) | 17 |
| 763 (SEQ ID NO: 1318) | 27 |
| 764 (SEQ ID NO: 1319) | 21 |
| 765 (SEQ ID NO: 1320) | 37 |
| 766 (SEQ ID NO: 1321) | 59 |
| 767 (SEQ ID NO: 1322) | 48 |
| 768 (SEQ ID NO: 1323) | 49 |
| 769 (SEQ ID NO: 1324) | 62 |
| 770 (SEQ ID NO: 1325) | 65 |
| 771 (SEQ ID NO: 1326) | 69 |
| 772 (SEQ ID NO: 1327) | 23 |

TABLE 15-continued

| ASO # | Relative expression of UNC13A CE |
|---|---|
| 773 (SEQ ID NO: 1328) | 35 |
| 774 (SEQ ID NO: 1329) | 42 |
| 775 (SEQ ID NO: 1330) | 27 |
| 776 (SEQ ID NO: 1331) | 38 |
| 777 (SEQ ID NO: 1332) | 22 |
| 778 (SEQ ID NO: 1333) | 21 |
| 779 (SEQ ID NO: 1334) | 30 |
| 780 (SEQ ID NO: 1335) | 32 |
| 781 (SEQ ID NO: 1336) | 24 |
| 782 (SEQ ID NO: 1337) | 34 |
| 783 (SEQ ID NO: 1338) | 45 |
| 784 (SEQ ID NO: 1339) | 30 |
| 785 (SEQ ID NO: 1340) | 24 |
| 786 (SEQ ID NO: 1341) | 27 |
| 787 (SEQ ID NO: 1342) | 36 |
| 788 (SEQ ID NO: 1343) | 64 |
| 789 (SEQ ID NO: 1344) | 68 |
| 790 (SEQ ID NO: 1345) | 70 |
| 791 (SEQ ID NO: 1346) | 66 |
| 792 (SEQ ID NO: 1347) | 24 |
| 793 (SEQ ID NO: 1348) | 22 |
| 794 (SEQ ID NO: 1349) | 36 |
| 795 (SEQ ID NO: 1350) | 38 |
| 796 ([1Gs][iAs][iAs][iTs][i$^5$Cs][iTs][iAs][n3s]-SEQ ID NO: 1351) | 53 |
| 797 ([1Gs][iAs][iAs][iTs][i$^5$Cs][iTs][iAs][n6s]-SEQ ID NO: 1351) | 60 |
| 798 ([1Gs][iAs][iAs][iTs][i$^5$Cs][iTs][iAs][n3s]-SEQ ID NO: 1352) | 54 |
| 799 ([1Gs][iAs][iAs][iTs][i$^5$Cs][iTs][iAs][n6s]-SEQ ID NO: 1352) | 58 |
| 800 ([1Gs][iAs][iAs][iTs][i$^5$Cs][iTs][iAs][i$^5$Cs][i$^5$Cs][n3s]-SEQ ID NO: 1353) | 50 |
| 801 ([1Gs][iAs][iAs][iTs][i$^5$Cs][iTs][iAs][i$^5$Cs][i$^5$Cs][n6s]-SEQ ID NO: 1353) | 47 |
| 802 ([1Gs][iAs][iAs][iTs][i$^5$Cs][iTs][iAs][i$^5$Cs][i$^5$Cs][n3s]-SEQ ID NO: 1354) | 33 |
| 803 ([1Gs][iAs][iAs][iTs][1$^5$Cs][iTs][iAs][i$^5$Cs][i$^5$Cs][n6s]-SEQ ID NO: 1354) | 45 |
| 804 ([1Gs][iAs][iAs][iTs][1$^5$Cs][iTs][iAs][i$^5$Cs][n3s]-SEQ ID NO: 1354) | 58 |
| 805 ([1Gs][iAs][iAs][iTs][i$^5$Cs][iTs][iAs][i$^5$Cs][n3s]-SEQ ID NO: 1351) | 43 |
| 806 ([1Gs][iAs][iAs][iTs][i$^5$Cs][iTs][iAs][i$^5$Cs][n6s]-SEQ ID NO: 1351) | 66 |
| 807 (SEQ ID NO: 1355) | 10 |
| 808 (SEQ ID NO: 1356) | 8 |
| 809 (SEQ ID NO: 1357) | 36 |
| 810 (SEQ ID NO: 1358) | 28 |
| 811 (SEQ ID NO: 1359) | 57 |
| 812 (SEQ ID NO: 1360) | 69 |
| 813 (SEQ ID NO: 1361) | 67 |
| 814 (SEQ ID NO: 1362) | 69 |

Additional Embodiments

1. An antisense oligonucleotide comprising a first antisense sequence targeting a first target region and a second antisense sequence targeting a second target region, wherein the first target region and/or the second target region each comprises an UNC13A sequence, wherein the antisense oligonucleotide modulates splicing of an UNC13A cryptic exon.

2. The antisense oligonucleotide of embodiment 1, wherein the UNC13A cryptic exon is in intron 20 of an UNC13A pre-mRNA.

3. The antisense oligonucleotide of embodiment 1 or embodiment 2, wherein the first target region and the second target region are in intron 20 of an UNC13A pre-mRNA.

4. The antisense oligonucleotide of any one of embodiments 1-3, wherein the first target region is adjacent to the second target region in an UNC13A pre-mRNA.

5. The antisense oligonucleotide of any one of embodiments 1-4, wherein the first target region is downstream of the second target region in an UNC13A pre-mRNA.

6. The antisense oligonucleotide of any one of embodiments 1-5, wherein the first target region is more than 1 nucleoside downstream of the second target region.

7. The antisense oligonucleotide of any one of embodiments 1-6, wherein the first target region and the second target region are both in the cryptic exon.

8. The antisense oligonucleotide of any one of embodiments 1-6, wherein the first target region is downstream of the cryptic exon and the second target region is in the cryptic exon.

9. The antisense oligonucleotide of any one of embodiments 1-6, wherein the first target region and the second target region are both downstream of the cryptic exon.

10. The antisense oligonucleotide of any one of embodiments 1-8, where in the first target region and/or the second target region comprises a nucleotide sequence of any one of SEQ ID NOs: 313-316.

11. The antisense oligonucleotide of any one of embodiments 1-10, wherein the first target region comprises the nucleotide sequence of SEQ ID NO: 315, and the second target region comprises the nucleotide sequence of SEQ ID NO: 315.

12. The antisense oligonucleotide of any one of embodiments 1-10, wherein the first target region comprises the nucleotide sequence of SEQ ID NO: 315, and the second target region comprises the nucleotide sequence of SEQ ID NO: 314.

13. The antisense oligonucleotide of any one of embodiments 1-10, wherein the first target region comprises the nucleotide sequence of SEQ ID NO: 315, and the second target region comprises the nucleotide sequence of SEQ ID NO: 313.

14. The antisense oligonucleotide of any one of embodiments 1-10, wherein the first target region comprises the nucleotide sequence of SEQ ID NO: 313, and the second target region comprises the nucleotide sequence of SEQ ID NO: 313.

15. The antisense oligonucleotide of any one of embodiments 1-14, wherein the first antisense sequence and/or the second antisense sequence is 6-15 nucleosides in length, optionally wherein the first antisense sequence and/or the second antisense sequence is 8-15 nucleosides in length.

16. The antisense oligonucleotide of any one of embodiments 1-15, wherein the first antisense sequence comprises at least 8 contiguous nucleobases of any one of SEQ ID NOS: 191-245, and/or wherein the second antisense sequence comprises at least 8 contiguous nucleobases of any one of SEQ ID NOs: 194, 199, 212, 226, 227, and 246-306.

17. The antisense oligonucleotide of any one of embodiments 1-16, wherein the first antisense sequence comprises the nucleobase sequence of any one of SEQ ID NOs: 191-245, and/or wherein the second antisense sequence comprises the nucleobase sequence of any one of SEQ ID NOs: SEQ ID NOs: 194, 199, 212, 226, 227, and 246-306.

18. The antisense oligonucleotide of any one of embodiments 1-17, wherein the first antisense sequence and the second antisense sequence are immediately adjacent to each other.

19. The antisense oligonucleotide of any one of embodiments 1-18, wherein one or more nucleobases are between the first antisense sequence and the second antisense sequence.

20. The antisense oligonucleotide of any one of embodiments 1-17, wherein one or more nucleobases at the 3' end of the first antisense sequence is complementary to one or more nucleobases at the 3' end of the second target region, and/or one or more nucleobases at the 5' end of the second antisense sequence is complementary to one or more nucleobases at the 5' end of the first target region.

21. The antisense oligonucleotide of any one of embodiments 1-20, comprising the nucleobase sequence of any one of SEQ ID NOs: 1-190.

22. The antisense oligonucleotide of any one of embodiments 1-21, comprising one or more modified nucleosides.

23. The antisense oligonucleotide of embodiment 22, wherein the one or more modified nucleosides comprise a non-bicyclic 2'modified nucleoside, a 2'-4' bridged nucleoside, or combinations thereof.

24. The antisense oligonucleotide of embodiment 23, wherein the non-bicyclic 2'-modified nucleoside is a 2'-O-methoxyethyl (2'-MOE) modified nucleoside, a 2'-O-Methyl (2'-O-Me) nucleoside, or a 2'-fluoro (2'-F) modified nucleoside, and/or the 2'-4' bridged nucleoside is a locked nucleic acid (LNA, 2'-4' methylene bridge), an ethylene-bridged nucleic acid (ENA, 2'-4' ethylene bridge), or a constrained ethyl nucleic acid (cEt, 2'-4' ethylene bridge).

25. The antisense oligonucleotide of any one of embodiments 1-24, wherein the antisense oligonucleotide comprises one or more 2'-MOE modified nucleosides and one or more LNAs.

26. The antisense oligonucleotide of any one of embodiments 1-24, wherein each nucleoside of the antisense oligonucleotide is a 2'-MOE modified nucleoside.

27. The antisense oligonucleotide of any one of embodiments 1-26, comprising one or more modified internucleoside linkages.

28. The antisense oligonucleotide of any one of embodiments 1-27, wherein each internucleoside linkage of the oligonucleotide is a modified internucleoside linkage.

29. The antisense oligonucleotide of embodiment 27 or embodiment 28, wherein the modified internucleoside linkage is a phosphorothioate linkage.

30. The antisense oligonucleotide of any one of embodiments 1-29, wherein each internucleoside linkage of the oligonucleotide is a phosphorothioate linkage.

31. The antisense oligonucleotide of any one of embodiments 1-29, wherein the antisense oligonucleotide comprises a mix of phosphodiester linkages and phosphorothioate linkages.

32. The antisense oligonucleotide of any one of embodiments 1-22, wherein the antisense oligonucleotide is a phosphorodiamidate oligomer (PMO).

33. The antisense oligonucleotide of any one of embodiments 1-32, wherein each cytosine of the oligonucleotide is not a 5-methyl-cytosine.

34. The antisense oligonucleotide of any one of embodiments 1-32, wherein each cytosine of the oligonucleotide is a 5-methyl-cytosine.

35. The antisense oligonucleotide of any one of embodiments 1-32, wherein one or more of the cytosines of the oligonucleotide is a 5-methyl-cytosine.

36. The antisense oligonucleotide of any one of embodiments 1-35, comprising a structure as provided in Table 5.

37. The antisense oligonucleotide of any one of embodiments 1-36, wherein the antisense oligonucleotide inhibits inclusion of the UNC13A cryptic exon into an UNC13A mature mRNA.

38. The antisense oligonucleotide of any one of embodiments 1-37, wherein the antisense oligonucleotide is in the form of a pharmaceutically acceptable salt.

39. A composition comprising the antisense oligonucleotide of any one of embodiments 1-38.

40. The composition of embodiment 39, further comprising a pharmaceutically acceptable carrier.

41. A method of inhibiting inclusion of an UNC13A cryptic exon into an UNC13A mature mRNA and/or restoring UNC13A expression in a cell, comprising contacting the cell with the antisense oligonucleotide of any one of embodiments 1-38, or the composition of embodiment 39 or embodiment 40.

42. A method of inhibiting inclusion of an UNC13A cryptic exon into an UNC13A mature mRNA and/or restoring UNC13A expression in a cell of a subject, comprising administering to the subject the antisense oligonucleotide of any one of embodiments 1-38, or the composition of embodiment 39 or embodiment 40.

43. A method of treating a disease associated with abnormal UNC13A expression in a subject, comprising administering to the subject the antisense oligonucleotide of any one of embodiments 1-38, or the composition of embodiment 39 or embodiment 40.

44. A method of treating a disease associated with TDP-43 dysfunction in a subject, comprising administering to the subject the antisense oligonucleotide of any one of embodiments 1-38, or the composition of embodiment 39 or embodiment 40.

45. The method of embodiment 43 or embodiment 44, wherein the disease is a neurodegenerative disease.

46. The method of any one of embodiments 43-45, wherein the neurodegenerative disease is amyotrophic lateral sclerosis (ALS).

47. The method of any one of embodiments 43-45, wherein the neurodegenerative disease is frontotemporal dementia (FTD).

48. The method of any one of embodiments 42-47, wherein the subject is human.

49. The method of any one of embodiments 42-48, wherein the subject has decreased expression of TDP-43 gene or protein.

50. The method of any one of embodiments 42-49, wherein the subject does not possess an SOD-1 gene mutation.

51. The method of any one of embodiments 42-50, wherein the subject possesses an UNC13A gene mutation in intron 20.

52. The method of embodiment 51, wherein the UNC13A gene mutation comprises rs12608932, rs12973192, rs56041637, rs116169349, rs62121687, or any combination thereof.

53. A pharmaceutical composition for use in a method of inhibiting inclusion of an UNC13A cryptic exon into an UNC13A mature mRNA and/or restoring UNC13A expression in a cell of a subject, comprising the antisense oligonucleotide of any one of embodiments 1-38.

54. A pharmaceutical composition for use in a method of treating a disease associated with abnormal UNC13A expression in a subject comprising the antisense oligonucleotide of any one of embodiments 1-38.

55. A pharmaceutical composition for use in a method of treating a disease associated with TDP-43 dysfunction in a subject comprising the antisense oligonucleotide of any one of embodiments 1-38.

56. The pharmaceutical composition of any one of embodiments 53-55, further comprising a pharmaceutically acceptable carrier.

57. The pharmaceutical composition of any one of embodiments 53-56, wherein the subject is human.

58. The pharmaceutical composition of any one of embodiments 55-57, wherein the subject has decreased expression of TDP-43 gene or protein.

59. The pharmaceutical composition of any one of embodiments 55-58, wherein the subject does not possess an SOD-1 gene mutation.

60. The pharmaceutical composition of any one of embodiments 55-59, wherein the subject possesses an UNC13A gene mutation in intron 20.

61. The pharmaceutical composition of embodiment 60, wherein the UNC13A gene mutation comprises rs12608932, rs12973192, rs56041637, rs116169349, rs62121687, or any combination thereof.

62. An antisense oligonucleotide of any one of embodiments 1-38 for use as a medicament.

63. The antisense oligonucleotide of embodiment 62, wherein the medicament is administered to a subject.

64. An antisense oligonucleotide of any one of embodiments 1-38 for use in a method of treating a disease associated with abnormal UNC13A expression in a subject, the method comprising administering to the subject an antisense oligonucleotide provided herein.

65. An antisense oligonucleotide of any one of embodiments 1-38 for use in a method of treating a disease associated with TDP-43 dysfunction in a subject, the method comprising administering to the subject an antisense oligonucleotide provided herein.

66. The antisense oligonucleotide of any one of embodiments 63-65, wherein the subject is human.

67. The antisense oligonucleotide of any one of embodiments 63-66, wherein the subject has decreased expression of TDP-43 gene or protein.

68. The antisense oligonucleotide of any one of embodiments 63-67, wherein the subject does not possess an SOD-1 gene mutation.

69. The antisense oligonucleotide of any one of embodiments 63-68, wherein the subject possesses an UNC13A gene mutation in intron 20.

70. The antisense oligonucleotide of embodiment 69, wherein the UNC13A gene mutation comprises rs12608932, rs12973192, rs56041637, rs116169349, rs62121687, or any combination thereof.

EQUIVALENTS

The disclosure may be embodied in other specific forms without departing from the spirit or essential characteristics thereof. The foregoing embodiments are therefore to be considered in all respects illustrative rather than limiting of the disclosure. Scope of the disclosure is thus indicated by the appended claims rather than by the foregoing description, and all changes that come within the meaning and range of equivalency of the claims are therefore intended to be embraced herein.

SEQUENCE LISTING (1364 sequences)

SEQ ID NO: 1 - DNA, 26 bp, synthetic construct
  source 1..26: mol_type = other DNA
cacgaatctacccccatccatgtact

SEQ ID NO: 2 - DNA, 26 bp, synthetic construct
  source 1..26: mol_type = other DNA
cgaatctacccacatctgttcaatca

SEQ ID NO: 3 - DNA, 26 bp, synthetic construct
  source 1..26: mol_type = other DNA
cacgaatctaccccatccatgtactc

SEQ ID NO: 4 - DNA, 26 bp, synthetic construct
  source 1..26: mol_type = other DNA
cgaatctacccacgagttctttccag

SEQ ID NO: 5 - DNA, 26 bp, synthetic construct
  source 1..26: mol_type = other DNA
cgaatctacccactaagagttctttc

SEQ ID NO: 6 - DNA, 26 bp, synthetic construct
  source 1..26: mol_type = other DNA
ccacgaatctaccgataagagttctt

SEQ ID NO: 7 - DNA, 26 bp, synthetic construct
  source 1..26: mol_type = other DNA
cacgaatctacccggataagagttct

SEQ ID NO: 8 - DNA, 26 bp, synthetic construct
  source 1..26: mol_type = other DNA
ccacgaatctaccggataagagttct

SEQ ID NO: 9 - DNA, 26 bp, synthetic construct
  source 1..26: mol_type = other DNA
tgttcaatcattcgggataagagttc

SEQ ID NO: 10 - DNA, 26 bp, synthetic construct
  source 1..26: mol_type = other DNA
gaatctacccaccgggataagagttc

SEQ ID NO: 11 - DNA, 26 bp, synthetic construct
  source 1..26: mol_type = other DNA
cgaatctacccacgggataagagttc

SEQ ID NO: 12 - DNA, 26 bp, synthetic construct
  source 1..26: mol_type = other DNA
acgaatctacccagggataagagttc

SEQ ID NO: 13 - DNA, 26 bp, synthetic construct
  source 1..26: mol_type = other DNA
cacgaatctacccgggataagagttc

SEQ ID NO: 14 - DNA, 26 bp, synthetic construct
  source 1..26: mol_type = other DNA
ccacgaatctaccgggataagagttc

SEQ ID NO: 15 - DNA, 26 bp, synthetic construct
  source 1..26: mol_type = other DNA
ctagccacgaatcgggataagagttc

SEQ ID NO: 16 - DNA, 26 bp, synthetic construct
  source 1..26: mol_type = other DNA
ccatccatcatccgggataagagttc

SEQ ID NO: 17 - DNA, 26 bp, synthetic construct
  source 1..26: mol_type = other DNA
gcatttattcaacggggataagagtt

SEQ ID NO: 18 - DNA, 26 bp, synthetic construct
  source 1..26: mol_type = other DNA
ccaccaactcatcggggataagagtt

SEQ ID NO: 19 - DNA, 26 bp, synthetic construct
  source 1..26: mol_type = other DNA
gaatctacccaccggggataagagtt

SEQ ID NO: 20 - DNA, 26 bp, synthetic construct
  source 1..26: mol_type = other DNA
cgaatctacccacggggataagagtt

SEQ ID NO: 21 - DNA, 26 bp, synthetic construct
  source 1..26: mol_type = other DNA
cacgaatctacccggggataagagtt

SEQ ID NO: 22 - DNA, 26 bp, synthetic construct
  source 1..26: mol_type = other DNA
ccacgaatctaccggggataagagtt

SEQ ID NO: 23 - DNA, 26 bp, synthetic construct
  source 1..26: mol_type = other DNA
gccacgaatctacggggataagagtt

SEQ ID NO: 24 - DNA, 26 bp, synthetic construct
  source 1..26: mol_type = other DNA
cgaatctacccaccctggggataaga

SEQ ID NO: 25 - DNA, 26 bp, synthetic construct
  source 1..26: mol_type = other DNA
acgaatctacccatcctggggataag

SEQ ID NO: 26 - DNA, 26 bp, synthetic construct
  source 1..26: mol_type = other DNA
cgaatctacccacgttcctggggata

SEQ ID NO: 27 - DNA, 26 bp, synthetic construct
  source 1..26: mol_type = other DNA
cacgaatctacccgttcctggggata

SEQ ID NO: 28 - DNA, 26 bp, synthetic construct
  source 1..26: mol_type = other DNA
ctagccacgaatcgttcctggggata

SEQ ID NO: 29 - DNA, 26 bp, synthetic construct
  source 1..26: mol_type = other DNA
cgaatctacccactagttcctgggga

SEQ ID NO: 30 - DNA, 26 bp, synthetic construct
  source 1..26: mol_type = other DNA
ctagccacgaatctagttcctgggga

SEQ ID NO: 31 - DNA, 26 bp, synthetic construct
  source 1..26: mol_type = other DNA
acgaatctacccactagttcctgggg

SEQ ID NO: 32 - DNA, 26 bp, synthetic construct
  source 1..26: mol_type = other DNA
atctagccacgaactagttcctgggg

SEQ ID NO: 33 - DNA, 24 bp, synthetic construct
  source 1..24: mol_type = other DNA
gaatctacccactctgttcaatca

SEQ ID NO: 34 - DNA, 24 bp, synthetic construct
  source 1..24: mol_type = other DNA
cgaatctacccatctgttcaatca

SEQ ID NO: 35 - DNA, 24 bp, synthetic construct
  source 1..24: mol_type = other DNA
gaatctacccacatctgttcaatc

SEQ ID NO: 36 - DNA, 24 bp, synthetic construct
  source 1..24: mol_type = other DNA
cgaatctacccaatctgttcaatc

SEQ ID NO: 37 - DNA, 24 bp, synthetic construct
  source 1..24: mol_type = other DNA
acgaatctacccccatccatgtac

SEQ ID NO: 38 - DNA, 25 bp, synthetic construct
  source 1..25: mol_type = other DNA
cacgaatctaccccatccatgtact

SEQ ID NO: 39 - DNA, 25 bp, synthetic construct
  source 1..25: mol_type = other DNA
acgaatctacccccatccatgtact

SEQ ID NO: 40 - DNA, 25 bp, synthetic construct
  source 1..25: mol_type = other DNA
cacgaatctacccccatccatgtac

SEQ ID NO: 41 - DNA, 27 bp, synthetic construct
  source 1..27: mol_type = other DNA
cacgaatctaccctccatccatgtact

SEQ ID NO: 42 - DNA, 27 bp, synthetic construct
  source 1..27: mol_type = other DNA
cacgaatctacccaccatccatgtact

SEQ ID NO: 43 - DNA, 24 bp, synthetic construct
  source 1..24: mol_type = other DNA
acgaatctaccccatccatgtact

SEQ ID NO: 44 - DNA, 25 bp, synthetic construct
  source 1..25: mol_type = other DNA
cacgaatctacccatccatgtactc

SEQ ID NO: 45 - DNA, 25 bp, synthetic construct
  source 1..25: mol_type = other DNA
acgaatctaccccatccatgtactc

SEQ ID NO: 46 - DNA, 27 bp, synthetic construct
  source 1..27: mol_type = other DNA
cacgaatctaccccatccatgtactca

SEQ ID NO: 47 - DNA, 24 bp, synthetic construct
  source 1..24: mol_type = other DNA
ccatccatcatcgggataagagtt

SEQ ID NO: 48 - DNA, 24 bp, synthetic construct
  source 1..24: mol_type = other DNA
ccatccatcatcggataagagttc

SEQ ID NO: 49 - DNA, 24 bp, synthetic construct
  source 1..24: mol_type = other DNA
catccatcatccgggataagagtt

SEQ ID NO: 50 - DNA, 24 bp, synthetic construct
  source 1..24: mol_type = other DNA
catccatcatccggataagagttc

SEQ ID NO: 51 - DNA, 25 bp, synthetic construct
  source 1..25: mol_type = other DNA
ccatccatcatcgggataagagttc

SEQ ID NO: 52 - DNA, 25 bp, synthetic construct
  source 1..25: mol_type = other DNA
catccatcatccgggataagagttc

SEQ ID NO: 53 - DNA, 25 bp, synthetic construct
  source 1..25: mol_type = other DNA
ccatccatcatccgggataagagtt

SEQ ID NO: 54 - DNA, 25 bp, synthetic construct
  source 1..25: mol_type = other DNA
ccatccatcatccggataagagttc

SEQ ID NO: 55 - DNA, 27 bp, synthetic construct
  source 1..27: mol_type = other DNA
ccatccatcatccggggataagagttc

SEQ ID NO: 56 - DNA, 27 bp, synthetic construct
  source 1..27: mol_type = other DNA
ccatccatcatccgggataagagttct

SEQ ID NO: 57 - DNA, 27 bp, synthetic construct
  source 1..27: mol_type = other DNA
tccatccatcatccgggataagagttc

SEQ ID NO: 58 - DNA, 24 bp, synthetic construct
  source 1..24: mol_type = other DNA
gttcaatcattcgggataagagtt

SEQ ID NO: 59 - DNA, 24 bp, synthetic construct
  source 1..24: mol_type = other DNA
gttcaatcattcggataagagttc

SEQ ID NO: 60 - DNA, 25 bp, synthetic construct
  source 1..25: mol_type = other DNA
gttcaatcattcgggataagagttc

SEQ ID NO: 61 - DNA, 25 bp, synthetic construct
  source 1..25: mol_type = other DNA
tgttcaatcattcggataagagttc

SEQ ID NO: 62 - DNA, 27 bp, synthetic construct
  source 1..27: mol_type = other DNA
tgttcaatcattcgggataagagttct

SEQ ID NO: 63 - DNA, 25 bp, synthetic construct
  source 1..25: mol_type = other DNA
gaatctacccacatctgttcaatca

SEQ ID NO: 64 - DNA, 25 bp, synthetic construct
  source 1..25: mol_type = other DNA
cgaatctacccacatctgttcaatc

SEQ ID NO: 65 - DNA, 27 bp, synthetic construct
  source 1..27: mol_type = other DNA
cgaatctacccaccatctgttcaatca

SEQ ID NO: 66 - DNA, 27 bp, synthetic construct
  source 1..27: mol_type = other DNA
cacgaatctaccccccatccatgtact

SEQ ID NO: 67 - DNA, 27 bp, synthetic construct
  source 1..27: mol_type = other DNA
cacgaatctacccgccatccatgtact

SEQ ID NO: 68 - DNA, 27 bp, synthetic construct
  source 1..27: mol_type = other DNA
cacgaatctaccctcatccatgtactc

SEQ ID NO: 69 - DNA, 27 bp, synthetic construct
  source 1..27: mol_type = other DNA
cacgaatctacccgcatccatgtactc

SEQ ID NO: 70 - DNA, 27 bp, synthetic construct
  source 1..27: mol_type = other DNA
tgttcaatcattccgggataagagttc

SEQ ID NO: 71 - DNA, 27 bp, synthetic construct
  source 1..27: mol_type = other DNA
ccatccatcatcccgggataagagttc

SEQ ID NO: 72 - DNA, 28 bp, synthetic construct
  source 1..28: mol_type = other DNA
cacgaatctaccccaccatccatgtact

SEQ ID NO: 73 - DNA, 28 bp, synthetic construct
  source 1..28: mol_type = other DNA
cacgaatctaccctcccatccatgtact

SEQ ID NO: 74 - DNA, 28 bp, synthetic construct
  source 1..28: mol_type = other DNA
cacgaatctacccccccatccatgtact

SEQ ID NO: 75 - DNA, 28 bp, synthetic construct
  source 1..28: mol_type = other DNA
cacgaatctacccctcatccatgtactc

SEQ ID NO: 76 - DNA, 28 bp, synthetic construct
  source 1..28: mol_type = other DNA
cacgaatctacccttcatccatgtactc

SEQ ID NO: 77 - DNA, 28 bp, synthetic construct
  source 1..28: mol_type = other DNA
tgttcaatcattccagggataagagttc

SEQ ID NO: 78 - DNA, 28 bp, synthetic construct
  source 1..28: mol_type = other DNA
tgttcaatcattcctgggataagagttc

SEQ ID NO: 79 - DNA, 28 bp, synthetic construct
  source 1..28: mol_type = other DNA
ccatccatcatcccagggataagagttc

SEQ ID NO: 80 - DNA, 28 bp, synthetic construct
  source 1..28: mol_type = other DNA
ccatccatcatcctcgggataagagttc

SEQ ID NO: 81 - DNA, 28 bp, synthetic construct
  source 1..28: mol_type = other DNA
ccatccatcatccttgggataagagttc

SEQ ID NO: 82 - DNA, 20 bp, synthetic construct
  source 1..20: mol_type = other DNA
cgaatctaccatccatgtac

SEQ ID NO: 83 - DNA, 22 bp, synthetic construct
  source 1..22: mol_type = other DNA
aatctacccacctgttcaatca

SEQ ID NO: 84 - DNA, 22 bp, synthetic construct
  source 1..22: mol_type = other DNA
aatctacccacatctgttcaat

SEQ ID NO: 85 - DNA, 22 bp, synthetic construct
  source 1..22: mol_type = other DNA
cgaatctacccctgttcaatca

SEQ ID NO: 86 - DNA, 22 bp, synthetic construct
  source 1..22: mol_type = other DNA
cgaatctacccatctgttcaat

SEQ ID NO: 87 - DNA, 26 bp, synthetic construct
  source 1..26: mol_type = other DNA
acgaatctacccaatctgttcaatca

SEQ ID NO: 88 - DNA, 26 bp, synthetic construct
  source 1..26: mol_type = other DNA
cacgaatctacccatctgttcaatca

SEQ ID NO: 89 - DNA, 26 bp, synthetic construct
  source 1..26: mol_type = other DNA
gaatctacccaccatctgttcaatca

SEQ ID NO: 90 - DNA, 26 bp, synthetic construct
  source 1..26: mol_type = other DNA
aatctacccaccaatctgttcaatca

SEQ ID NO: 91 - DNA, 26 bp, synthetic construct
  source 1..26: mol_type = other DNA
cgaatctacccactctgttcaatcat

SEQ ID NO: 92 - DNA, 26 bp, synthetic construct
  source 1..26: mol_type = other DNA
cgaatctacccactcatctgttcaat

SEQ ID NO: 93 - DNA, 26 bp, synthetic construct
  source 1..26: mol_type = other DNA
acgaatctacccacatctgttcaatc

SEQ ID NO: 94 - DNA, 26 bp, synthetic construct
  source 1..26: mol_type = other DNA
gaatctacccacccatctgttcaatc

SEQ ID NO: 95 - DNA, 26 bp, synthetic construct
  source 1..26: mol_type = other DNA
acgaatctacccatctgttcaatcat

SEQ ID NO: 96 - DNA, 26 bp, synthetic construct
  source 1..26: mol_type = other DNA
gaatctacccacctctgttcaatcat

SEQ ID NO: 97 - DNA, 26 bp, synthetic construct
  source 1..26: mol_type = other DNA
ccacgaatctacctcaatcattcatt

SEQ ID NO: 98 - DNA, 26 bp, synthetic construct
  source 1..26: mol_type = other DNA
cgaatctacccacctctgttcaatca

SEQ ID NO: 99 - DNA, 26 bp, synthetic construct
  source 1..26: mol_type = other DNA
acgaatctacccactctgttcaatca

SEQ ID NO: 100 - DNA, 26 bp, synthetic construct
  source 1..26: mol_type = other DNA
cgaatctacccaatctgttcaatcat

SEQ ID NO: 101 - DNA, 26 bp, synthetic construct
  source 1..26: mol_type = other DNA
gaatctacccacatctgttcaatcat

SEQ ID NO: 102 - DNA, 22 bp, synthetic construct
  source 1..22: mol_type = other DNA
aatctacccactctgttcaatc

SEQ ID NO: 103 - DNA, 22 bp, synthetic construct
  source 1..22: mol_type = other DNA
cgaatctaccctctgttcaatc

SEQ ID NO: 104 - DNA, 22 bp, synthetic construct
  source 1..22: mol_type = other DNA
gaatctacccactgttcaatca

SEQ ID NO: 105 - DNA, 22 bp, synthetic construct
  source 1..22: mol_type = other DNA
gaatctacccaatctgttcaat

SEQ ID NO: 106 - DNA, 22 bp, synthetic construct
  source 1..22: mol_type = other DNA
gaatctacccatctgttcaatc

SEQ ID NO: 107 - DNA, 26 bp, synthetic construct
  source 1..26: mol_type = other DNA
caaatctacccacatctgttcaatca

SEQ ID NO: 108 - DNA, 26 bp, synthetic construct
  source 1..26: mol_type = other DNA
cgaatctacccacatctattcaatca

SEQ ID NO: 109 - DNA, 26 bp, synthetic construct
  source 1..26: mol_type = other DNA
caaatctacccacatctattcaatca

SEQ ID NO: 110 - DNA, 24 bp, synthetic construct
  source 1..24: mol_type = other DNA
cgaatctacccaatctattcaatc

SEQ ID NO: 111 - DNA, 24 bp, synthetic construct
  source 1..24: mol_type = other DNA
cgaatctacccacatctgttcaat

SEQ ID NO: 112 - DNA, 24 bp, synthetic construct
  source 1..24: mol_type = other DNA
cgaatctacccatcatctgttcaa

SEQ ID NO: 113 - DNA, 24 bp, synthetic construct
  source 1..24: mol_type = other DNA
acgaatctacccatctgttcaatc

SEQ ID NO: 114 - DNA, 24 bp, synthetic construct
  source 1..24: mol_type = other DNA
acgaatctaccccatctgttcaat

SEQ ID NO: 115 - DNA, 24 bp, synthetic construct
  source 1..24: mol_type = other DNA
cacgaatctacccatccatgtact

SEQ ID NO: 116 - DNA, 24 bp, synthetic construct
  source 1..24: mol_type = other DNA
cacgaatctaccccatccatgtac

SEQ ID NO: 117 - DNA, 24 bp, synthetic construct
  source 1..24: mol_type = other DNA
catttattcaacgggataagagtt

SEQ ID NO: 118 - DNA, 24 bp, synthetic construct
  source 1..24: mol_type = other DNA
catttattcaacggggataagagt

SEQ ID NO: 119 - DNA, 26 bp, synthetic construct
  source 1..26: mol_type = other DNA
atccatccatcattggggataagagt

SEQ ID NO: 120 - DNA, 26 bp, synthetic construct
  source 1..26: mol_type = other DNA
tccatccatcatcggggataagagtt

SEQ ID NO: 121 - DNA, 26 bp, synthetic construct
  source 1..26: mol_type = other DNA
tccatccatcatcgggataagagttc

SEQ ID NO: 122 - DNA, 26 bp, synthetic construct
  source 1..26: mol_type = other DNA
tccatccatcatcggataagagttct

SEQ ID NO: 123 - DNA, 26 bp, synthetic construct
  source 1..26: mol_type = other DNA
ccatccatcatccgataagagttctt

SEQ ID NO: 124 - DNA, 26 bp, synthetic construct
  source 1..26: mol_type = other DNA
gcatttattcaacgggataagagttc

SEQ ID NO: 125 - DNA, 26 bp, synthetic construct
  source 1..26: mol_type = other DNA
gcatttattcaacggataagagttct

SEQ ID NO: 126 - DNA, 26 bp, synthetic construct
  source 1..26: mol_type = other DNA
cgaatctacccacccttttatctact

SEQ ID NO: 127 - DNA, 26 bp, synthetic construct
  source 1..26: mol_type = other DNA
cgaatctacccaccatgtactcaccc

SEQ ID NO: 128 - DNA, 26 bp, synthetic construct
  source 1..26: mol_type = other DNA
cacgaatctacccccatccttttatc

SEQ ID NO: 129 - DNA, 26 bp, synthetic construct
  source 1..26: mol_type = other DNA
cacgaatctacccctgttcaatcatt

SEQ ID NO: 130 - DNA, 26 bp, synthetic construct
  source 1..26: mol_type = other DNA
cacgaatctacccgttcaatcattca

SEQ ID NO: 131 - DNA, 26 bp, synthetic construct
  source 1..26: mol_type = other DNA
cgaatctacccactccttttatctac

SEQ ID NO: 132 - DNA, 26 bp, synthetic construct
  source 1..26: mol_type = other DNA
cgaatctacccacctgttcaatcatt

SEQ ID NO: 133 - DNA, 26 bp, synthetic construct
  source 1..26: mol_type = other DNA
cgaatctacccaccttttatctactc

SEQ ID NO: 134 - DNA, 26 bp, synthetic construct
  source 1..26: mol_type = other DNA
cgaatctacccacgttcaatcattca

SEQ ID NO: 135 - DNA, 26 bp, synthetic construct
  source 1..26: mol_type = other DNA
acgaatctacccagtactcacccatc

SEQ ID NO: 136 - DNA, 26 bp, synthetic construct
  source 1..26: mol_type = other DNA
cgaatctacccactgttcaatcattc

SEQ ID NO: 137 - DNA, 26 bp, synthetic construct
  source 1..26: mol_type = other DNA
cacgaatctaccccatctgttcaatc

SEQ ID NO: 138 - DNA, 26 bp, synthetic construct
  source 1..26: mol_type = other DNA
cacgaatctacccccttttatctact

SEQ ID NO: 139 - DNA, 26 bp, synthetic construct
  source 1..26: mol_type = other DNA
cacgaatctacccccatgtactcacc

SEQ ID NO: 140 - DNA, 26 bp, synthetic construct
  source 1..26: mol_type = other DNA
cgaatctacccacattcaccagcatt

SEQ ID NO: 141 - DNA, 26 bp, synthetic construct
  source 1..26: mol_type = other DNA
cgaatctacccaccatctgttcaatc

SEQ ID NO: 142 - DNA, 26 bp, synthetic construct
  source 1..26: mol_type = other DNA
acgaatctacccaccatccttttatc

SEQ ID NO: 143 - DNA, 26 bp, synthetic construct
  source 1..26: mol_type = other DNA
cgaatctacccacgtactcacccatc

SEQ ID NO: 144 - DNA, 26 bp, synthetic construct
  source 1..26: mol_type = other DNA
cacgaatctacccgtactcacccatc

SEQ ID NO: 145 - DNA, 26 bp, synthetic construct
  source 1..26: mol_type = other DNA
acgaatctacccaattcaccagcatt

SEQ ID NO: 146 - DNA, 26 bp, synthetic construct
  source 1..26: mol_type = other DNA
cgaatctacccacgaaacccaggcag

SEQ ID NO: 147 - DNA, 26 bp, synthetic construct
  source 1..26: mol_type = other DNA
ccacgaatctaccggaaacccaggca

SEQ ID NO: 148 - DNA, 26 bp, synthetic construct
  source 1..26: mol_type = other DNA
caatcatatatccggaaacccaggca

SEQ ID NO: 149 - DNA, 26 bp, synthetic construct
  source 1..26: mol_type = other DNA
caatagttcaatcggaaacccaggca

SEQ ID NO: 150 - DNA, 26 bp, synthetic construct
  source 1..26: mol_type = other DNA
tctagccacgaatttccaggaaaccc

SEQ ID NO: 151 - DNA, 26 bp, synthetic construct
  source 1..26: mol_type = other DNA
gtactcacccatcgataagagttctt

SEQ ID NO: 152 - DNA, 26 bp, synthetic construct
  source 1..26: mol_type = other DNA
ccatgtactcaccggataagagttct

SEQ ID NO: 153 - DNA, 26 bp, synthetic construct
  source 1..26: mol_type = other DNA
tgtccatccatccggataagagttct

SEQ ID NO: 154 - DNA, 26 bp, synthetic construct
  source 1..26: mol_type = other DNA
ttcattcaccagcgggataagagttc

SEQ ID NO: 155 - DNA, 26 bp, synthetic construct
  source 1..26: mol_type = other DNA
ctactcatcactcgggataagagttc

SEQ ID NO: 156 - DNA, 26 bp, synthetic construct
  source 1..26: mol_type = other DNA
tctccatccatccgggataagagttc

SEQ ID NO: 157 - DNA, 26 bp, synthetic construct
  source 1..26: mol_type = other DNA
gtactcacccatcgggataagagttc

SEQ ID NO: 158 - DNA, 26 bp, synthetic construct
  source 1..26: mol_type = other DNA
catgtactcacccgggataagagttc

SEQ ID NO: 159 - DNA, 26 bp, synthetic construct
  source 1..26: mol_type = other DNA
catccatctatccgggataagagttc

SEQ ID NO: 160 - DNA, 26 bp, synthetic construct
  source 1..26: mol_type = other DNA
ccatccatctgtcgggataagagttc

SEQ ID NO: 161 - DNA, 26 bp, synthetic construct
  source 1..26: mol_type = other DNA
ccagcatttattcggggataagagtt

SEQ ID NO: 162 - DNA, 26 bp, synthetic construct
  source 1..26: mol_type = other DNA
ttcattcaccagcggggataagagtt

SEQ ID NO: 163 - DNA, 26 bp, synthetic construct
  source 1..26: mol_type = other DNA
tgttcaatcattcggggataagagtt

SEQ ID NO: 164 - DNA, 26 bp, synthetic construct
  source 1..26: mol_type = other DNA
ttatctactcatcggggataagagtt

SEQ ID NO: 165 - DNA, 26 bp, synthetic construct
  source 1..26: mol_type = other DNA
cacccatctctccggggataagagtt

SEQ ID NO: 166 - DNA, 26 bp, synthetic construct
  source 1..26: mol_type = other DNA
gtactcacccatcggggataagagtt

SEQ ID NO: 167 - DNA, 26 bp, synthetic construct
  source 1..26: mol_type = other DNA
catgtactcacccggggataagagtt

SEQ ID NO: 168 - DNA, 26 bp, synthetic construct
  source 1..26: mol_type = other DNA
ccatctatccatcggggataagagtt

SEQ ID NO: 169 - DNA, 26 bp, synthetic construct
  source 1..26: mol_type = other DNA
catccatctagccggggataagagtt

SEQ ID NO: 170 - DNA, 26 bp, synthetic construct
  source 1..26: mol_type = other DNA
ctgtccatccatcggggataagagtt

SEQ ID NO: 171 - DNA, 26 bp, synthetic construct
  source 1..26: mol_type = other DNA
caatcatatatccggggataagagtt

SEQ ID NO: 172 - DNA, 26 bp, synthetic construct
  source 1..26: mol_type = other DNA
ccatctagccacgttcctggggataa

SEQ ID NO: 173 - DNA, 26 bp, synthetic construct
  source 1..26: mol_type = other DNA
catgtactcacccgttcctggggata

SEQ ID NO: 174 - DNA, 26 bp, synthetic construct
  source 1..26: mol_type = other DNA
ctagccacgaatcactagttcctggg

SEQ ID NO: 175 - DNA, 26 bp, synthetic construct
  source 1..26: mol_type = other DNA
ccacgaatctaccgcatttattcaac

SEQ ID NO: 176 - DNA, 26 bp, synthetic construct
  source 1..26: mol_type = other DNA
ctagccacgaatcgtactcacccatc

SEQ ID NO: 177 - DNA, 24 bp, synthetic construct
  source 1..24: mol_type = other DNA
gaatctacccacttcaccagcatt

SEQ ID NO: 178 - DNA, 24 bp, synthetic construct
  source 1..24: mol_type = other DNA
cgaatctacccattcaccagcatt

SEQ ID NO: 179 - DNA, 24 bp, synthetic construct
  source 1..24: mol_type = other DNA
gaatctacccacattcaccagcat

SEQ ID NO: 180 - DNA, 24 bp, synthetic construct
  source 1..24: mol_type = other DNA
cgaatctacccaattcaccagcat

SEQ ID NO: 181 - DNA, 25 bp, synthetic construct
  source 1..25: mol_type = other DNA
gaatctacccacattcaccagcatt

SEQ ID NO: 182 - DNA, 25 bp, synthetic construct
  source 1..25: mol_type = other DNA
cgaatctacccacattcaccagcat

SEQ ID NO: 183 - DNA, 20 bp, synthetic construct
  source 1..20: mol_type = other DNA
catatatccatctagccacg

SEQ ID NO: 184 - DNA, 20 bp, synthetic construct
  source 1..20: mol_type = other DNA
acgaatctacccatccatgt

SEQ ID NO: 185 - DNA, 20 bp, synthetic construct
  source 1..20: mol_type = other DNA
tgtccatccacgaatctacc

SEQ ID NO: 186 - DNA, 20 bp, synthetic construct
  source 1..20: mol_type = other DNA
cgaatctaccaactcatcca

SEQ ID NO: 187 - DNA, 20 bp, synthetic construct
  source 1..20: mol_type = other DNA
acgaatctaccatccatgta

SEQ ID NO: 188 - DNA, 20 bp, synthetic construct
  source 1..20: mol_type = other DNA
cgaatctacccatctctcca

SEQ ID NO: 189 - DNA, 20 bp, synthetic construct
  source 1..20: mol_type = other DNA
cacgaatctacccatctctc

SEQ ID NO: 190 - DNA, 20 bp, synthetic construct
  source 1..20: mol_type = other DNA
acgaatctacccatctctcc

SEQ ID NO: 191 - DNA, 13 bp, synthetic construct
  source 1..13: mol_type = other DNA
cacgaatctaccc

SEQ ID NO: 192 - DNA, 13 bp, synthetic construct
  source 1..13: mol_type = other DNA
cgaatctacccac

SEQ ID NO: 193 - DNA, 13 bp, synthetic construct
  source 1..13: mol_type = other DNA
ccacgaatctacc

SEQ ID NO: 194 - DNA, 13 bp, synthetic construct
  source 1..13: mol_type = other DNA
tgttcaatcattc

SEQ ID NO: 195 - DNA, 13 bp, synthetic construct
  source 1..13: mol_type = other DNA
gaatctacccacc

SEQ ID NO: 196 - DNA, 13 bp, synthetic construct
  source 1..13: mol_type = other DNA
acgaatctaccca

SEQ ID NO: 197 - DNA, 13 bp, synthetic construct
  source 1..13: mol_type = other DNA
ctagccacgaatc

SEQ ID NO: 198 - DNA, 13 bp, synthetic construct
  source 1..13: mol_type = other DNA
ccatccatcatcc

SEQ ID NO: 199 - DNA, 13 bp, synthetic construct
  source 1..13: mol_type = other DNA
gcatttattcaac

SEQ ID NO: 200 - DNA, 13 bp, synthetic construct
  source 1..13: mol_type = other DNA
ccaccaactcatc

SEQ ID NO: 201 - DNA, 13 bp, synthetic construct
  source 1..13: mol_type = other DNA
gccacgaatctac

SEQ ID NO: 202 - DNA, 13 bp, synthetic construct
  source 1..13: mol_type = other DNA
atctagccacgaa

SEQ ID NO: 203 - DNA, 12 bp, synthetic construct
  source 1..12: mol_type = other DNA
gaatctacccac

SEQ ID NO: 204 - DNA, 12 bp, synthetic construct
  source 1..12: mol_type = other DNA
cgaatctaccca

SEQ ID NO: 205 - DNA, 12 bp, synthetic construct
  source 1..12: mol_type = other DNA
acgaatctaccc

SEQ ID NO: 206 - DNA, 12 bp, synthetic construct
  source 1..12: mol_type = other DNA
cacgaatctacc

SEQ ID NO: 207 - DNA, 14 bp, synthetic construct
  source 1..14: mol_type = other DNA
cacgaatctaccca

SEQ ID NO: 208 - DNA, 12 bp, synthetic construct
  source 1..12: mol_type = other DNA
ccatccatcatc

SEQ ID NO: 209 - DNA, 12 bp, synthetic construct
  source 1..12: mol_type = other DNA
catccatcatcc

SEQ ID NO: 210 - DNA, 14 bp, synthetic construct
  source 1..14: mol_type = other DNA
tccatccatcatcc

SEQ ID NO: 211 - DNA, 12 bp, synthetic construct
  source 1..12: mol_type = other DNA
gttcaatcattc

SEQ ID NO: 212 - DNA, 10 bp, synthetic construct
  source 1..10: mol_type = other DNA
cgaatctacc

SEQ ID NO: 213 - DNA, 11 bp, synthetic construct
  source 1..11: mol_type = other DNA
aatctacccac

SEQ ID NO: 214 - DNA, 11 bp, synthetic construct
  source 1..11: mol_type = other DNA
cgaatctaccc

SEQ ID NO: 215 - DNA, 13 bp, synthetic construct
  source 1..13: mol_type = other DNA
aatctacccacca

SEQ ID NO: 216 - DNA, 14 bp, synthetic construct
  source 1..14: mol_type = other DNA
cgaatctacccacc

SEQ ID NO: 217 - DNA, 14 bp, synthetic construct
  source 1..14: mol_type = other DNA
acgaatctacccac

SEQ ID NO: 218 - DNA, 11 bp, synthetic construct
  source 1..11: mol_type = other DNA
gaatctaccca

SEQ ID NO: 219 - DNA, 13 bp, synthetic construct
  source 1..13: mol_type = other DNA
caaatctacccac

SEQ ID NO: 220 - DNA, 12 bp, synthetic construct
  source 1..12: mol_type = other DNA
catttattcaac

SEQ ID NO: 221 - DNA, 13 bp, synthetic construct
  source 1..13: mol_type = other DNA
atccatccatcat

SEQ ID NO: 222 - DNA, 13 bp, synthetic construct
  source 1..13: mol_type = other DNA
tccatccatcatc

SEQ ID NO: 223 - DNA, 13 bp, synthetic construct
  source 1..13: mol_type = other DNA
caatcatatatcc

SEQ ID NO: 224 - DNA, 13 bp, synthetic construct
  source 1..13: mol_type = other DNA
caatagttcaatc

SEQ ID NO: 225 - DNA, 13 bp, synthetic construct
  source 1..13: mol_type = other DNA
tctagccacgaat

SEQ ID NO: 226 - DNA, 13 bp, synthetic construct
  source 1..13: mol_type = other DNA
gtactcacccatc

SEQ ID NO: 227 - DNA, 13 bp, synthetic construct
  source 1..13: mol_type = other DNA
ccatgtactcacc

SEQ ID NO: 228 - DNA, 13 bp, synthetic construct
  source 1..13: mol_type = other DNA
tgtccatccatcc

SEQ ID NO: 229 - DNA, 13 bp, synthetic construct
  source 1..13: mol_type = other DNA
ttcattcaccagc

SEQ ID NO: 230 - DNA, 13 bp, synthetic construct
  source 1..13: mol_type = other DNA
ctactcatcactc

SEQ ID NO: 231 - DNA, 13 bp, synthetic construct
  source 1..13: mol_type = other DNA
tctccatccatcc

SEQ ID NO: 232 - DNA, 13 bp, synthetic construct
  source 1..13: mol_type = other DNA
catgtactcaccc

SEQ ID NO: 233 - DNA, 13 bp, synthetic construct
  source 1..13: mol_type = other DNA
catccatctatcc

SEQ ID NO: 234 - DNA, 13 bp, synthetic construct
  source 1..13: mol_type = other DNA
ccatccatctgtc

SEQ ID NO: 235 - DNA, 13 bp, synthetic construct
  source 1..13: mol_type = other DNA
ccagcatttattc

SEQ ID NO: 236 - DNA, 13 bp, synthetic construct
  source 1..13: mol_type = other DNA
ttatctactcatc

SEQ ID NO: 237 - DNA, 13 bp, synthetic construct
  source 1..13: mol_type = other DNA
cacccatctctcc

SEQ ID NO: 238 - DNA, 13 bp, synthetic construct
  source 1..13: mol_type = other DNA
ccatctatccatc

SEQ ID NO: 239 - DNA, 13 bp, synthetic construct
  source 1..13: mol_type = other DNA
catccatctagcc

SEQ ID NO: 240 - DNA, 13 bp, synthetic construct
  source 1..13: mol_type = other DNA
ctgtccatccatc

SEQ ID NO: 241 - DNA, 13 bp, synthetic construct
  source 1..13: mol_type = other DNA
ccatctagccacg

SEQ ID NO: 242 - DNA, 10 bp, synthetic construct
  source 1..10: mol_type = other DNA
catatatcca

SEQ ID NO: 243 - DNA, 10 bp, synthetic construct
  source 1..10: mol_type = other DNA
acgaatctac

SEQ ID NO: 244 - DNA, 10 bp, synthetic construct
  source 1..10: mol_type = other DNA
tgtccatcca

SEQ ID NO: 245 - DNA, 10 bp, synthetic construct
  source 1..10: mol_type = other DNA
cacgaatcta

SEQ ID NO: 246 - DNA, 13 bp, synthetic construct
  source 1..13: mol_type = other DNA
ccatccatgtact

SEQ ID NO: 247 - DNA, 13 bp, synthetic construct
  source 1..13: mol_type = other DNA
atctgttcaatca

SEQ ID NO: 248 - DNA, 13 bp, synthetic construct
  source 1..13: mol_type = other DNA
catccatgtactc

SEQ ID NO: 249 - DNA, 13 bp, synthetic construct
  source 1..13: mol_type = other DNA
gagttctttccag

SEQ ID NO: 250 - DNA, 13 bp, synthetic construct
  source 1..13: mol_type = other DNA
taagagttctttc

SEQ ID NO: 251 - DNA, 13 bp, synthetic construct
  source 1..13: mol_type = other DNA
gataagagttctt

SEQ ID NO: 252 - DNA, 13 bp, synthetic construct
  source 1..13: mol_type = other DNA
ggataagagttct

SEQ ID NO: 253 - DNA, 13 bp, synthetic construct
  source 1..13: mol_type = other DNA
gggataagagttc

SEQ ID NO: 254 - DNA, 13 bp, synthetic construct
  source 1..13: mol_type = other DNA
ggggataagagtt

SEQ ID NO: 255 - DNA, 13 bp, synthetic construct
  source 1..13: mol_type = other DNA
cctggggataaga

SEQ ID NO: 256 - DNA, 13 bp, synthetic construct
  source 1..13: mol_type = other DNA
tcctggggataag

SEQ ID NO: 257 - DNA, 13 bp, synthetic construct
  source 1..13: mol_type = other DNA
gttcctggggata

SEQ ID NO: 258 - DNA, 13 bp, synthetic construct
  source 1..13: mol_type = other DNA
tagttcctgggga

SEQ ID NO: 259 - DNA, 13 bp, synthetic construct
  source 1..13: mol_type = other DNA
ctagttcctgggg

SEQ ID NO: 260 - DNA, 12 bp, synthetic construct
  source 1..12: mol_type = other DNA
tctgttcaatca

SEQ ID NO: 261 - DNA, 12 bp, synthetic construct
  source 1..12: mol_type = other DNA
atctgttcaatc

SEQ ID NO: 262 - DNA, 12 bp, synthetic construct
  source 1..12: mol_type = other DNA
ccatccatgtac

SEQ ID NO: 263 - DNA, 14 bp, synthetic construct
  source 1..14: mol_type = other DNA
tccatccatgtact

SEQ ID NO: 264 - DNA, 12 bp, synthetic construct
  source 1..12: mol_type = other DNA
catccatgtact

SEQ ID NO: 265 - DNA, 14 bp, synthetic construct
  source 1..14: mol_type = other DNA
catccatgtactca

SEQ ID NO: 266 - DNA, 12 bp, synthetic construct
  source 1..12: mol_type = other DNA
gggataagagtt

SEQ ID NO: 267 - DNA, 12 bp, synthetic construct
  source 1..12: mol_type = other DNA
ggataagagttc

SEQ ID NO: 268 - DNA, 14 bp, synthetic construct
  source 1..14: mol_type = other DNA
ggggataagagttc

SEQ ID NO: 269 - DNA, 14 bp, synthetic construct
  source 1..14: mol_type = other DNA
gggataagagttct

SEQ ID NO: 270 - DNA, 14 bp, synthetic construct
  source 1..14: mol_type = other DNA
catctgttcaatca

SEQ ID NO: 271 - DNA, 10 bp, synthetic construct
  source 1..10: mol_type = other DNA
atccatgtac

SEQ ID NO: 272 - DNA, 11 bp, synthetic construct
  source 1..11: mol_type = other DNA
ctgttcaatca

SEQ ID NO: 273 - DNA, 11 bp, synthetic construct
  source 1..11: mol_type = other DNA
atctgttcaat

SEQ ID NO: 274 - DNA, 13 bp, synthetic construct
  source 1..13: mol_type = other DNA
tctgttcaatcat

SEQ ID NO: 275 - DNA, 13 bp, synthetic construct
  source 1..13: mol_type = other DNA
tcatctgttcaat

SEQ ID NO: 276 - DNA, 13 bp, synthetic construct
  source 1..13: mol_type = other DNA
catctgttcaatc

SEQ ID NO: 277 - DNA, 13 bp, synthetic construct
  source 1..13: mol_type = other DNA
tcaatcattcatt

SEQ ID NO: 278 - DNA, 14 bp, synthetic construct
  source 1..14: mol_type = other DNA
atctgttcaatcat

SEQ ID NO: 279 - DNA, 11 bp, synthetic construct
  source 1..11: mol_type = other DNA
tctgttcaatc

SEQ ID NO: 280 - DNA, 13 bp, synthetic construct
  source 1..13: mol_type = other DNA
atctattcaatca

SEQ ID NO: 281 - DNA, 12 bp, synthetic construct
  source 1..12: mol_type = other DNA
atctattcaatc

SEQ ID NO: 282 - DNA, 12 bp, synthetic construct
  source 1..12: mol_type = other DNA
catctgttcaat

SEQ ID NO: 283 - DNA, 12 bp, synthetic construct
  source 1..12: mol_type = other DNA
tcatctgttcaa

SEQ ID NO: 284 - DNA, 12 bp, synthetic construct
  source 1..12: mol_type = other DNA
ggggataagagt

SEQ ID NO: 285 - DNA, 13 bp, synthetic construct
  source 1..13: mol_type = other DNA
tggggataagagt

SEQ ID NO: 286 - DNA, 13 bp, synthetic construct
  source 1..13: mol_type = other DNA
ccttttatctact

SEQ ID NO: 287 - DNA, 13 bp, synthetic construct
  source 1..13: mol_type = other DNA
ccatccttttatc

SEQ ID NO: 288 - DNA, 13 bp, synthetic construct
  source 1..13: mol_type = other DNA
ctgttcaatcatt

SEQ ID NO: 289 - DNA, 13 bp, synthetic construct
  source 1..13: mol_type = other DNA
gttcaatcattca

SEQ ID NO: 290 - DNA, 13 bp, synthetic construct
  source 1..13: mol_type = other DNA
tccttttatctac

SEQ ID NO: 291 - DNA, 13 bp, synthetic construct
  source 1..13: mol_type = other DNA
cttttatctactc

SEQ ID NO: 292 - DNA, 13 bp, synthetic construct
  source 1..13: mol_type = other DNA
attcaccagcatt

SEQ ID NO: 293 - DNA, 13 bp, synthetic construct
  source 1..13: mol_type = other DNA
gaaacccaggcag

SEQ ID NO: 294 - DNA, 13 bp, synthetic construct
  source 1..13: mol_type = other DNA
ggaaacccaggca

SEQ ID NO: 295 - DNA, 13 bp, synthetic construct
  source 1..13: mol_type = other DNA
ttccaggaaaccc

SEQ ID NO: 296 - DNA, 13 bp, synthetic construct
  source 1..13: mol_type = other DNA
ttcctggggataa

SEQ ID NO: 297 - DNA, 13 bp, synthetic construct
  source 1..13: mol_type = other DNA
actagttcctggg

SEQ ID NO: 298 - DNA, 12 bp, synthetic construct
  source 1..12: mol_type = other DNA
ttcaccagcatt

SEQ ID NO: 299 - DNA, 12 bp, synthetic construct
  source 1..12: mol_type = other DNA
attcaccagcat

SEQ ID NO: 300 - DNA, 10 bp, synthetic construct
  source 1..10: mol_type = other DNA
tctagccacg

SEQ ID NO: 301 - DNA, 10 bp, synthetic construct
  source 1..10: mol_type = other DNA
ccatccatgt

SEQ ID NO: 302 - DNA, 10 bp, synthetic construct
  source 1..10: mol_type = other DNA
aactcatcca

SEQ ID NO: 303 - DNA, 10 bp, synthetic construct
  source 1..10: mol_type = other DNA
catccatgta

SEQ ID NO: 304 - DNA, 10 bp, synthetic construct
  source 1..10: mol_type = other DNA
catctctcca

SEQ ID NO: 305 - DNA, 10 bp, synthetic construct
  source 1..10: mol_type = other DNA
cccatctctc

SEQ ID NO: 306 - DNA, 10 bp, synthetic construct
  source 1..10: mol_type = other DNA
ccatctctcc

SEQ ID NO: 307 - DNA, 9985 bp, Homo sapiens
  source 1..9985: mol_type = genomic DNA
gcccccggtgctgaaccaagatggccggtggcggccgggccccggcgtgagccaagcgcgggctgcagccgggagatgccccagcccagcggccgctgagcccgacccgacagagccggcccggccgcctccggcccacctgcgagctcggagacatgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacaca

SEQ ID NO: 308 - protein, 1703 aa, Homo sapiens
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 309 - DNA, 10004 bp, Macaca fascicularis
  source 1..10004: mol_type = genomic DNA
gccacgtcaggcgctgtccgcgcccccggtgctgaaccaagatggccggtggcggccgggccccggcgtgagccaagcgcgggctgcagccgggagatgccccagcccagcggccgctgagcccgacccgacagagccggcccggccgcctccggtccgcctgcgagcccggagacatgtctctgctgtgcgttggagagaaattcaacacgtacgtgaccctgaaagttcagaatgtcaagagcacgaccatcgcggtgcggggcagccagcccagctgggagcaggatttcatgttcgagattaaccgtctggatttgggactgacagtggaggtgtggaacaaaggtctcatctgggacacaatggtgggcactgtgtggatcccactgcggaccatccgccagtccaatgaggagggccctggagagtggctgacactggactcccaggtcatcatggcagacagtgagatctgcggcaccaaggaccccactttccaccgcatcctcctggacacgcgctttgagctgcccttagacattccggaagaggaggctcgctactgggccaagaagctggagcagctcaacgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgcgacagtgactaccgcagtgaaacgagcaacagcatcccgccgccctattacactacgtcgcaacccaacgcctcagtccaccagtattctgttcgcccaccacccctgggctcccgggaatcctacagcgactccatgcacagttatgaggagttctctgagccgcaggccctcagccccacaggtagcagccgctacgcctcctcagcggagctgagccagggaagctctcagctgagtgaggacttcgaccccgacgagcacagcctgcagggctccgagatggaggacgagcgggaccgggactcctaccactcctgccacagctcggtcagctatcacaaagactcacctcgctgggaccaggatgaggaggagctggaggaggacctggaggacttcctggaggaggaggagctgcctgaagacgaggaggagctggaggaggaggaggaggtgcctgacgatttgggcagctatgcccagcgtgaagaggtggctgtggctgagcccaaagacttcaaacgcatcagcctcccgccagctgccccagggaaggaggacaagaccccattggcacccaccgaggcccccgacacggccaaggtggcccccaagccagccacacccgaggaggtgcctgcagctgagcagatccctgaggctgagccccccaaggctgaggagagtttcaggccgagagaggatgaggaaggccaggaggggcaggactccatgtccagggccaaggccaactggctgcgtgccttcaacaaggtgcggatgcagctgcaggaggcccggggtgaaggagaaatgtccaaatccctatggttcaaaggcggcccaggaggtggtctcatcatcatcgacagcatgccagacatccgcaagaggaaacctatcccactcgtgagcgacctggccatgtccctggtccagtccaggaaagcaggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcacggagtgtggtgtcaagtgccacgaaaagtgccaggacctgctcaacgccgattgcctgcagcgggctgcggagaagagctccaagcacggggcggaggaccggacgcagaacatcatcatggtgctcaaggaccgcatgaagatccgggagcgcaacaagcccgagatcttcgagctcatccaggagatcttcgcggtgaccaagacggcgcacacgcaacagatgaaggcggtcaagcagagcgtgctggacggcacgtccaagtggtccgccaagatcagcatcaccgtggtctgcgcgcagggcttgcaggcaaaggacaagacgggatccagtgacccctacgtcaccgtccaggttgggaagaccaagaaacggacaaaaaccatctatgggaacctcaacccggtgtgggaggagaatttccactttgaatgtcacaattcctccgaccgcatcaaggtgcgcgtctgggacgaggatgatgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgctgtgtcgggtgccatccggctccacatcagtgtggagatcaaaggcgaggagaaggtggccccataccatgtccagtatacctgtctgcatgagaacctgttccactttgtgaccgacgtgcagaacaatggggttgtgaagatcccggatgccaagggcgacgatgcctggaaggtttactacgatgagacagcccaggagattgtggacgagtttgccatgcgctacggcgttgagtccatctaccaagccatgacccactttgcctgcctctcctccaagtatatgtgcccgggggtgcctgccgtcatgagcaccctactcgccaacatcaatgcctactacgcgcacaccaccgcctccaccaacgtgtctgcctctgaccgcttcgccgcctccaactttgggaaagagcgcttcgtgaaactcctggaccagctgcataactccctgcggattgacctctccatgtaccggaataacttcccagccagcagcccagagagactccaggacctcaaatccactgtggaccttctcaccagcatcaccttctttcggatgaaggtacaagaactccagagcccgccccgagccagccaggtggtaaaggattgtgtgaaagcctgccttaattctacctacgagtacatcttcaacaactgccatgaactctacagccgggagtaccagacagacccggcgaagaagggggaagttcccccagaggaacaggggcccagcatcaagaacctcgacttctggtccaagctgattaccctcatagtgtccatcattgaggaagacaagaattcctacactccctgcctcaatcagtttccccaggagctgaatgtgggtaaaatcagcgctgaagtgatgtggaatctgtttgcccaagacatgaagtatgccatggaggagcacgacaagcatcgtctatgcaagagtgccgactacatgaacctccacttcaaggtgaaatggctctacaatgagtatgtgacggaacttcccgcctttaaggaccgcgtgcctgagtaccctgcatggtttgaacccttcgtcatccagtggctggacgagaatgaggaggtgtcccgggatttcctgcacggtgccctggagcgagacaagaaggatgggttccagcagacctcagagcatgccctattctcctgctccgtggtggacgtcttctcccaactcaaccagagctttgaaatcatcaagaaacttgagtgtcccgacccccagattgtggggcactacatgaggcgctttgccaagaccatcagtaatgtgctcctccagtatgcagacatcatctccaaggacttcgcctcctactgctccaaggagaaggagaaagtgccctgcatcctcatgaacaacactcaacagctacgagttcagctggagaagatgttcgaagccatgggaggaaaggagctggatgccgaagccagtgacatcttgaaggagcttcaggtgaaactcaataacgtcttggatgagctcagccgggtgtttgctaccagcttccagccgcacattgaagagtgtgttaaacagatgggtgacatccttagccaggttaagggcacaggcaatgtgccagccagtgcctgcagcagcgtggcccaggacgctgacaatgtgttgcagcccatcatggacctgctggacagcaacctgaccctctttgccaaaatctgtgagaagacggtgctgaagcgagtgctgaaggagctgtggaagctggttatgaacactatggagaaaaccatcgtcctgccacccctcaccgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggaccacatggtacgagaagaagccaagagcttgaccccaaagcagtgcgcggtggttgagttggccctggacacaatcaagcaatatttccatgcgggtggcgtgggcctcaagaagaccttcctggagaagagcccggacctgcaatccctgcgctatgccctgtcgctctacacacaggccaccgacctgctcattaagacctttgtacagacgcaatcggcccaggtccatggtggaaaaggtactaggtttacccttagtgaagacatttatcctgagaagggcttgggtgtagaagaccctgtgggtgaagtctccgtccacgttgagctgtttactcatccaggaactggggaacacaaggtcacagtgaaagtggtggctgccaatgacctcaaatggcagacttctggcatcttccggccgttcatcgaggtcaacatcattgggccccagctcagcgacaagaaacgcaagtttgcgaccaaatccaagaacaatagctgggctcccaagtacaatgagagcttccagtttacgctgagcgccgacgcgggccccgagtgctacgagctgcaggtgtgcgtcaaggactactgcttcgcgcgcgaggaccgcacggtggggctggccgtgctgcagctgcgcgagctggcccagcgcgggagtgccgcctgctggctgccgctaggccgtcgcatccacatggacgacaccggcctcacggtcctgcgaatcctctcgcagcgcagcaacgacgaggtggccaaagagttcgtgaaactcaagtcggacacgcgctcagccgaggagggtggtgccgcgcctgcgccttagcgcggggcgggcggccgagcggcactgcgcctgcgcggagggcgctgggcggggaggggcttgcgtctcggtgggacctccccaggggcggggctcgggagactacacgccgagggtgggctgcgcctacgcccttgactgagctctcccttttggagaattaggaatggaggatgccccgccctctcgggaggccacgcccaagggcgcgatgaaggaagaagccacatccccaacttgaggccacgcccccagcatctagggggcattttgagctgggatgggggaaacctcgtccccatggaggaggccacatcccggcgctccggtactgggaggcacagcctcctgtcccctggaaaagccataagacgggacccagacccctgggaccccagaccaattgccaagtatggaaatctcagctccctcaagggggggccctgggcaagggatagagcttcctggagggcccctctaggtgatctggggactggagggaccaggattctggttggagggccccggaataccggagtccctttagatgtttgtgcaaaaaataaatggggggaggggggaggatgggatttcaaaagcacatgcgccttgggcgcccaaaccctgggggccgaggggacggctctggggcacccacgctgcccctacttccctttgggagtttgcctctccctctcccccaacaaacccagtcctcatatcatagatttcaacacacccatttgacagatggcaaaactgaggctcaaagagctgcttgagacttggccgaggttccaggtgccataccctctattcctctcccttaggcctgtgtgccccatgaaagggtgggctgagatcgggatgacctgacacagctccctattgctgctaattccccctcgggggcctcctccaaggggtgggagttccaggccaagacccctactttgcctttccttctccggctgccaagcaagacccctgccctcagccctttctcctggcattccatgggggatgccatgaggacctcccaccacaaaagagaatttgggatcccctggtcccaggtttctccaccccttcttcctttcccagaattttccaaataggaaagaacagaaagaaaccagaaactctaggggggagagagagaatgagagagagagaaagagagagagagagaaacccaaacacagtgagagcttagtctccaagatcctatttattgattcaaacacccaagccacaggatacctcagatggccctctagcctgctggaagccctttatccagtaagcaaagttgccgtgacttggctgcagttaaccttgtgcacacaggaccttaggggaaagttcagtgtggaccatatttgctctgggatctgcttttcctcgtgctcgtatggcacgcctttttctgctggattgagaaagacaagattttgctgtgctagggagaaatgaaaacggggtgagatgagtagctgggttcctggaggatggaacatcagatggggaggctttctgaggtgaagaatgagagggaaccacttactagagagaaaagagctccaggcctgggaacagcatgtgcgaagaccaggagaggagaactgttgaaacaaggagaaaggtggcacagctggagctgagccagcaagggggatcatgaggagccttggggttggggagatctgcagaagcatcagaccaggcaggaccttgtacgctgtcctgaggagtttcacttttattctaagacagtcggggagctccaggagatgtttaagctggggagagattggattccagcctgcaaaagctgttttgtgaagactaaaaccagtgaggaggggtgggggtgctttggagacactgaaatggattattggaaagattctgaaggctgtattgaaaagacacctataactgtggacatggctataatcccagcattttggggaggctgaggctggtggatcatttaaggtcaggagtttgagaccagcctggccaacgtggtgaaaccctgtctctgctaaaaatacaaaaattagctgggtgtggtggtgcatgcctgtaatcccagctacacaggagactgaggtgggagaattgcttgaaccctggaggcagaggttgcagtgagccaagatcacaccactgcactccagcctgggtaacagaccaatactccgttccctcccctctaccccccccaaaaaaaaaaaaaatcctgcgcttagatgagctccatggctgctgagtacagttgtcccagttgcacactgcccaagggtttggcatcgctaagaaggccacgtgcaaatcctagacattgagtgttgtatgtttatgaccttggtgtcccaacatgtgaatggcccaagtgtctggaagaagtggcgccactttctaatttgcttgaaggtgttgcgtgtcccctaaattcagacagatgcaggtaactggaggttctgaaccaaaggctaaaatgcaaattctcataaaggatttgggaagctgtagccagggataagcttatgtgactgtaatatgggctgaggagcagatgtgaatttcggaccatgccatgcctgagggtgggggtcgggtggatggatgattcagggttgtaacccatagagcccaaaggggaagttatctgtgacctgtggtgagggtgacctggaacatttttggatggctggaaagaaatggggaaattgagctgcctgagatagtcaggatatttcccaaaagattccttaggagtctttctggtcaagacgtgtgtgtgtgtgtgtgtgtgtgtttagggttccccaagaatggctcaggcatgtgaaggaaacaagcttcagggaatatttgttgaatgagttttcctgcctcccaggctagaactgtttttgcaatttccaccctcttttctttccctcccagagaactcctattcatcctttgaaacccatcatgaaaatccctcttggagaaaaccctccttccttcccctcaggactttcccagcctccatccctcctccagtccagcctgatgccatgggactggggtttctctcttcagctctgtttctcccagactggggtctgaggcctctcaggacccccaactttacctagcacaggttgggcacaggtggatggcagggagtctgtgcctagtggaattatgtgttggggcagtgtcagtgcgagaatacacatctgcatgtgtatctgtccatgtctgtccataccaaccttccccttccacacggacctgggcacataggaggtgtctgagcccaacacatgggacagagagtggacacggctgagacacggacagagacaagacaaggagtccaggcggctgaaagccttttgaaatcaggaagttcctggattggcagaacaaagcccagagaggagcagggctttccccatcgccacccagcaagtggccacagagcccagccttggatgacacctccaggattctgaaccctggacctcactttatgcaaggagctggccgcagatttccatgaatcagggaaacagcacaagagggttggcctgtggcagggcagggattaaaggggtaacattgagggatgcctcagagtcaaagtcccctgaccaagaggaataaagagtagaaggcacagagagggtgagatgacgccctgatgagaacggagagagacatagaggtggaaatatacagagaaagagaaatgcagagaccagggcagggggtgtcggggaaagtaaagagggtgtcccgaggaaagaaggctctgtccattgtcaccagtctgtcctcgaatgatttgcataaaatgaggaggtgcctgtccatgcccccaattcctctctcaggtgccagagcctgagacctcaccatgcccccatcagagatgcaaaaaactaaacacccaactagaaatccttgggacctctctcggctgggatcttagagcctttctgtccccgacccctaccccatgtgctgtcgattttgcagatggggacaacctggggcctcccggaactctgccaccctggggaagttggggggagggcgttggtcccggatcacaaccccgtctgctccccagaatcctttcctaagaatcgttgaggaccaaagtcgtctttgctgacacgtgttgcttttctctttgccttttattgttttagagaaaaatcaagttgactgtgtcaagtaacaccccacccccttacccccgtccagccatagtggctctctggagacacaggtcacaggcggagggtcccctgatcatccctgaccacacagccaggggtgtttgacccctgtccacccctgtctcgtgctccctcagacccccacaaaccggccaagcagtccggggatgcttcccctccacacaacttctcttagcatgtgattgcagatgtgaaatcaaagcgttgtttgttttttgttttgttttgattccaccccgtcggtctggtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccaca

SEQ ID NO: 310 - protein, 1711 aa, Macaca fascicularis
MSLLCVGEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSAELSQGSSQLSEDFDPDEHSLQGSEMEDERDRDSYHSCHSSVSYHKDSPRWDQDEEELEEDLEDFLEEEELPEDEEELEEEEEVPDDLGSYAQREEVAVAEPKDFKRISLPPAAPGKEDKTPLAPTEAPDTAKVAPKPATPEEVPAAEQIPEAEPPKAEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVPPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQVHGGKGTRFTLSEDIYPEKGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 311 - DNA, 1288 bp, synthetic construct
  source 1..1288: mol_type = other DNA
gtgagggtcattgctcggcccctcccatgccacttccactcaccattcctgcctgcccagctcttcctctttctggccacaccatccacactctcctggccctctgagactgcccgccatgccattccctttacctggaaaactcctccctatccatcaaagtccagattcagggtcacctcctctgggaagcccaccttggcctccaggttgactctcactactcatcatcaggttcttccttctattccagccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgggtgagtacatggatggatagatggatgagttggtgggtagattcgtggctagatggatgatggatggatggacagatggatggatatatgattgaactattgaaagtatagatgtatggatgggtgaatttgggggtaattgttagatgatggatgagtatagatgaatgatggatggataacttgatgagtggatagatagattgctggatagatgattgactgggtggatagatgaaatgttggatgagcagattaagttgtattggatgggatggatggaagtgtggttgagttattagaaggaagattgagtagataggtgaatttgttgatagtcagatgggtagataggtagatggatggatggatggatggatgtataggcagatggacaaatggatgaatgggtgggtggatgaatggaaggatgtgtggttgaactattgcaagtattgataattgggttcataatttctgaatatttagatggatggttgtgagtggctggtggacagacgaaaaatggatggttggataaattgatgggtggatggatggttggttgtatgaaagaatgaatgattgggtaggtggattaagttgcggatcaatgtatgggatggatgaatggatggatggatggatgtgtggttgaattactgaaaggttggaagagtggatgggtgaaatttggggtagttagatgggtgggtgtgtggatggataaaagagtagatgaatgaattaatgaataaacaggcagatggatgatgtaagctgccccagaccctgggacctctgacccccggcgaccccttgcactctccatgacactttctctcccatggtggcag

SEQ ID NO: 312 - DNA, 128 bp, synthetic construct
  source 1..128: mol_type = other DNA
ctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 313 - RNA, 92 nt, synthetic construct
  source 1..92: mol_type = other RNA
ctgggtatgtctcttccagctgcctgggtttcctggaaagaactcttatccccaggaactagtttgttgaataaatgctggtgaatgaatga

SEQ ID NO: 314 - RNA, 96 nt, synthetic construct
  source 1..96: mol_type = other RNA
gaataaatgctggtgaatgaatgaatgattgaacagatgaatgagtgatgagtagataaaaggatggatggagagatgggtgagtacatggatgga

SEQ ID NO: 315 - RNA, 92 nt, synthetic construct
  source 1..92: mol_type = other RNA
gagatgggtgagtacatggatggatagatggatgagttggtgggtagattcgtggctagatggatgatggatggatggacagatggatggat

SEQ ID NO: 316 - RNA, 51 nt, synthetic construct
  source 1..51: mol_type = other RNA
atggatggatggacagatggatggatatatgattgaactattgaaagtata

SEQ ID NO: 317 - DNA, 20 bp, synthetic construct
  source 1..20: mol_type = other DNA
  modified_base 1..20: mod_base = OTHER; note = phosphorothioate linkage
  modified_base order(1..4,16,18..20): mod_base = OTHER; note = 2 prime-O-methoxyethyl nucleoside
  modified_base order(5,17): mod_base = OTHER; note = 2 prime-O-methoxyethyl-5-methylcytidine
  modified_base 8: mod_base = OTHER; note = 5-methyl cytosine
aaggcttcatattgtacttt

SEQ ID NO: 318 - DNA, 32767 bp, Homo sapiens
  source 1..32767: mol_type = genomic DNA
gcccccggtgctgaaccaagatggccggtggcggccgggccccggcgtgagccaagcgcgggctgcagccgggagatgccccagcccagcggccgctgagcccgacccgacagagccggcccggccgcctccggcccacctgcgagctcggagacatgtctctgctttgcgttggaggtaggaggcgaggctgggggtcgggggacccgtgtggacgcgggctggggtcggggtccgcgtggatgcggctcccagggggttcctggggggtgacccgagtccaggtggctggacttttgagaggggtagcccttgtcgacgcagctgggccccggagggggtgatccgtgtagacgcggcagggctctcgggggtcctggtggccgctgctggaggggtcgtgtggacgcggctgaacgcggaggcccgtgtggacgtggacgggtatccggggttctacccggaaacgatctagactggggcgtctgtgtagaccaggtttttagagggtcagtgaggaagagtctgggctcggtagtttgattgaagcctgcaggggtgcttggaaggggtctggtgttgtgggctgggttacgggtcctcatggacgcggacccggctggaaattcgaaggagagtgcggtgggagggttctccaagccgtggggatgtaagatataggtagaggggcttggccatcagggcatccacgagttctaggactctcccagccctaggtgtaaagaggactggagtggggggagtgtggagacaggagacccctcccagcgtccagagagggctgtgactggaggtctgggggcgcttttccagttaactctttggcctcccgagtgagggggttggaggaatgtccagaaggtcttcccgctccctgccccctccggttctcccaaacacgtttcagggccttctcggcagggagcctacttcttggaagagcaatgtctcctggtccccctcctggcccatcctcacctcacccactttgcactggagagagggagggagggagacgtgaggtggggggggagctattttggggccagaacgccatctgcacagaggcccacgcccaggcccacgctctgcgttggggttggaggagggagggagacgtgggaggggcatgaccccccaccccacacctttatggctctggggtcgtggggaagccagcccaaccgaacccaggcgttctgggcactcccgtttgagaaatcaaactctgggagaccttgggcggcaggggtggatgtggaccgccgttccacgcctacagagctctgaacccctggttcttaaggactggggtccccccgtcactcccacccatttcaagaaggctggggtgggggaaggggtgtgtctgccaagcctgagactgcaggcttcgggagacctcgggcgacaggaagcgtgcgtgtgctgaactcctgctgcctggacacagggtgggcaggccggggagccgggaaccgcccccgccgcccctcctcctccctcccctccccctcggccgattcattcacaaaccctgccccgcccgcccgctccccgccgcggcagcttccgagtgcaaatccggccgggctgggccggcgtggacgcgggtgttcttaaagggacaggggcctactttctctaagctcgtttctgctggacggggctgggggtggtggaagaagggtccctagagtcaaaggtcaactcctccatcccctagcctccaggcctatggagttaggggagtagggaagtgaaggagacccctaggcgacccccaccgcctaggcctgaggacggaatgggaggagaacttgaatgtccagaccccctactgacctctccccctgctctaagtagccgggctcttaaaggtggcactggaggaggttccgacgtgggtgttcttggctgactcctctatcctctctcttctccccccagcatcccgccccaccccgcctcacatcctccaagttgggcttctctggaaggtttgcctagtggagtgggggggggggggggggggcggggatctcacccttaactctgacgcaaacaggaggctcggctgcgggggtggcattaagggggggcagcaggaggcaagagggatgaggcttccagaaacagagacgttgggggaggactgtgctggattctgtggactttacagggaggggcccggctgagtggagaggaatcgctgggaggggcaaggctggggaagaggttgacaggggtgggaggtaaggccctcaggtgtaaagggaggtgtgaggttggagtgaggaggagtaggaggcagggaggggtggggagagggagaagtgctgggtgaggccagtctcccagggagaggtgggatggtgcccagagaggggaggggctgggatggctgagcacgagagatgttggggtgggcttggcaggagtgaagctaggctgagatgggttgccgtgttgcctgagctcagctgaggaaatacctgtcccccctcccctccaccggggacccacaggcgtttgccaatccctacacacattcatacccagacttgttcctgtgtggacacaaatgcttaggatgtatgaaggctctacgcagaccatgtgcctgggaaggcacattccgtaggcacacgtgtgtactcaaatgcctgtgtgaacacaagcatacacgtgtatataggacacagtctgccgctacagatatagtcccagcaacacacgtgtgagtgtgtgtgtctgccagcacgcatatagatgtatccacgtgtctgatgaatgctcacaatatacatgtcacataaagatccacccatgtccagccgagcgcggtggctcaggcctgtaatctcatcactttgactttgggaggccaaggtgggcagatcacttgaggtcaggagttcaagaccagcctggccaacatggtgaaactttgtcactgctaaaaaataaaaaaaattagccaggtgtggtggcgcgcacctgtagtctcagctactcgggaggctgaggaaggagaatcacttgaataggggaggtggaggttgcagtgagctgagatcctgccactgtactccagcctgggcaacacagtgagactctgtctcaaaaaaaaagattcactcatgtcctaacactcagacatgtacccatacatatctgttaaggtccccaaccccatgaagcacatatatattcatataagcacatgtcaaagccatgtgtgtatgcacatgacaacacttgcctggacattcaaagcagcccctttcaacaagtggatgatgatgcatacaagtaaatacacatttgagtatttcattgcacacaagtgcatacatgtatgcagataaacaaatacagctgccacagaactgcatccatgtacacatgcaaacatcaatatgtgtgttttccacctaacatatcacccacaagctcacacacaccagtgtgtctctgatgtagtgacaccccactcctagacacacatgtgcagactcccacctgcacttaaatggtgcacatactctgcacacatgcacactcatatccatgtagaggcaggcacctgcctgccctggtaagatgagccaactactgctgcaaatacccaagcaagtacaggcaaatgcaagctcttgtgtatacacccagcaccaacacatagcagaccaccctgtatggtgtatgggccttatctctgcccgcttcatttatttattcatgtggtgccccgctgcttcccaacatcgtaatccactgactaggtcttggcaggatcctgaggctgtgaatggtaaatgccacctggttccttcatgaagtcacttattttatttatgcaacaagcattaattgagcacctactgtataccaggcactgttcctggctctgggacccagccctattcctagccatcactcctgcacgtcccatggggttagaatgaaagagatgagggagggctaagggagctgaggagtggggtatccagggctctcttcctctgggaagcctaccctgattccaccaccaccatttacttgagtctcagaagatgtgatgagggggagatgagcaggagggagatggtgctctgggtggagggaacagcatgagcaaaagcatggtggtgtgaagggttacttccagatcttcctatgtgcctcacagcattttgcacaggccacttgatgttttgttttgttttgagacagagtctcactcaaagcctgttactcaggctgcagtgcagtggcatgatctcagcttgctgcagccttgacctccagggctcaagtgatcctcctgcctcagcctcccaagtagctgggagtataggcatgcaccaccacacccggctgacttttttctttttaattttttgcagaagcagggttttgccctgctgcccaggctggtcttgaactcctgggctcaagtgattcaccctcctcagcctcccaaagtgctaggattacaggtgtgagccaccacgcccaactgatgttttaaaggctctataaacatgttatgaataaatgacatgaacaaatcagtgaatttaggtgagggtgggtttgcttcacaacttacaataatatcaacaacaaaccccatttatccagcttttttgtttgtttgtttgttttttgagacacggtctcactctgtcacccggactgcagtgtagtggtgtgatctcggttcactgaaacctccaccttccaagttcaagcgattttcctgcctcagcctcccgagtagctgggattacaggcacgtgctaccacacctagctagtttttgtatttttagtagagatggggtttctcatctctactaaaaatacaaatacatctctagtggccaggctggtcttgaactcctgacttcaagtgatcctcttgcctcggcctcccaatgtactgagattacaggctcgagccaccgtgcccagcccagcatttcataggcatgatgttaaggatttttatgcccatgccctctttaactcttacagtagccccattgtacagatgaggaaaactgaggctcagggagctttaacaacttgcctggtggaacagagccagaggtggagctgactgactctagagcctactggggttggcagaagtttgagccttctctcagaccccaggacctcggagacagccaagtcccttctgtggagtgatgttctgccctgggattgccttcttctttctatttatttatttattggagacagagtctggctctgttgcccaagctggagtgcagtggcacaatttcagttcactgtaacctcctcctcccgggttcaagcaattctcctgcctcagcctcctgagtagctgagattacagatgcacaccatcatgcccagctaattttttgtatttttagtggagatggggtttcaccatgctagccaggctggcctcgaactcctgaccaccaagtgatctacctgctttggcctcccaaagtgctgggattacaggcatgagccactgtgcccagccaggattgctttcttctctcatgcatctagtaaacagacatgtcacaatctctccattcatcggggctattcccctgctccttgcctaagaagccttcacacatccctccgttcctggctactcagtccctgataccctccagctaggaggagctgcatctaggtcttagctcctaccgttctcatgggatgccctccagagttgcatcttcagggctgcagcctaaccctttccctaacctggcctcacttttcttccacatacaatggacctcttctgcaaggtgccaataagggcatcctgggtccagcaggcctgagtgtgaattgctaagtccaccacttcctggcaagtctcacatcctctgcattccttggtgtgctcatctgtggaatgggcacaggagtagcatccaccatctacgtttgccagaactctctaatgaggcttgcagagcccctggcatgactcctggcctacgggaaggcccaataatcgtgagcaaaagacatgaaaaatcaatgatgggccggccccggtggctcacgcctgtaatcccagcactttgggaggcctaggcgggcagatctcctgagctcaggagttcaagaccaccctgggcaacatggtgaaaccctgtctttactaaaatacaaaaaaattagctgggtatggtggcgcgcgcctgtagtcccagctactcagggggctgaggcacgagaatcgcttaagccccgaaggcggaggttgcagtgagccgaggtcgcgccactgcactccagcttgggctacagagtgagactccgtcaaaaaaaaaaaaaaaaaaaaatcaatgatgatgtttttattaatggagactaaaagctttctggaaggcggttctgagtgcaggacatttctgagagtccactgcattctggggcccgaggagcgctccaagaggggtcccccagggccactccaggagggagcctagttcgttgagggtacacgggtgggaccgagcattcagcaccgtggacagcgcctgcccgcgcctctgggggacagctcttagctcagcctcccaggattaatggaggaggtgacgtcattccttccgtgaattactatttaatgagcacctactataggctaggcctacttctaagtggttcatggtaaacaacacacacacaaatcccttattcccgaagctctctggaactccaggttcttggtgttttttacactgaaggctcagtctggctctggtctatttgtgtcaacggaggataagggtcctcatttagtgtctcccagatgcgaaaccagcacagctgaggtcttttatcctaaagcccatccatctcccgctgaaatgccctccaccaacatcacacacaaaacgatcaaatctcctataatctatttctggattctctatgcttcctcccttcccccaagctaatcctggggcgggtgggctttcagaagccctagacggctggatctccacctcctgtctccccaccccatcccacgtggcaggtcagggagccagtgccccaagactgcagtcccccctaattagaatccagggtcagtcagccatgtggttcacgcctgtaattccaacactttgggaggccgaggggatggcttgagccttgaagccagccatagcaacatagcaagaccccatctctacaaaaaaaaaaaaaaaaaaaaaggaatagccaagcatggtgatgcgcacctgcagtctcagctactcgagaggctgagtggggaggatcgcttgaacctgggagatcgaggctgcagtgagccatgatcacaccactgccctccagcctggagcctgggcaacagagagagaccctgtcaaaaaaaaaaaaaaaaaaaaaaagaaaagaaaagaaaaaaaaagaagaagaagaagagaaaagaaagaaaaagaaaagaatccagggtattcaaatcctagaatccaggccagggacacctttagaacacaaccaaataataaaaacagtaaagatatcagtaataataataatagtataaatgacactataatcattctgcagaaggggtgagggaggaagaggagggaagaagaggaggagaaaggagagggaagggagatcagccactccgtctccccattttccagatgcagaaacggaggcgcgaagccaggctgcaggggtgtcccgcagcctgaactcctgcctcagcctccccgggtacggccactacattcatcagtcagcgcttctgggggccccaaagacctttgaggccgcatgacgcggtgtcttcacccgctcgtcgctggggacagcagtgggcacccccctcatccccgcccccctgtccgccggcgcgcctcccacgccctccgcgcgcccacgctataaatagcctcatgcgtgtgacccgaagcccgctggggaagggtggcgcttccgccccgctgaccctgatacagcaacccggcgcaggcggggaggtggcgggatgtgacgacgaagacggtgactcagggaccatttactgaccggggaagacagggagagagactgggttccttctctgagcccccttcctcctccaagcctctcccccgataccaccctcccctctgcgcccatcccccttcccgaatcccctccctcaccgcgaacacccttccctcctgagaaccccctcgccactctcggccccctttcctgtccccttttccctctgagacccctctcccactgggagccccagtgatgaaaaatcatggatgtcctcaacctggacctcggcagggagctaagtgcaggagcctggcttcagctatcagagggtacagccctccagccggtcccccactgcctgaggaccccaacggagaccattcccctctagccaagagaggctgcaggaaggagctgaggcttagggaagaggagccggactgaccaagggaggggcacaagaagggcagagacagtgagagagagaaggagagaacagagaccaaaagaagacgaccagagtggagagaaatagaacggggaggagggagatgagagacagggattgggaaagagagagagagaacagatcaaggagctactgggctccccgctgagcctaaatccatggtttataaaacagggcacagttggaggagcttcaagtgagcccagcccagtctagaccccagtgagccccttgtatcaccccccagagcctgtcactttcccacccccatatgcatccctacttttctcccccaactgcctctcctctccccagtgtctcctccacctgcctgccctccctagtggaaatctttccccctctctcttttattattattattattattatatattttttgagacagagtcttgctctgtcgcccaggctggagtgcaatggcgtgatcttggctcactgcaacctccgcctcctgggttcaagcgattctcctgcctcagcctcccgagtagctgggactacaggcgtgcaccatcatgcccggctaatttttgtatttttaatagagatggggttttaccatgttgcccaggctggtctcgaactcctgacctcatgtgatccacctgcctcggcctcaaagtgctgggattacagatgtgggctaccacgcccagcctctctcccttttaaattattatttttagacatgggatcttactacattgcccaggctggtcttgaactcctgggctcaagggatcctcctgccttagccttcctagtagctgggattacaggcatgtgcctctatgcctggtactctcgctgtctccttgtgtctctctatttctctccatctgtccagactctcctctcttgctttcatgcccatcatttcttcctctctcctctcccttcctctccctgtatgagtccctccagctgtgggtgcctttctcagcctctgtcagcatcccctccacccccgatcccgtcacattctacctcttgccccttcccctgcccacccccttcacagagagtccccacgcctgcaggctggacctcctccaggagccaggcccaaagctcctgctgggcacattcctgagtgttcctgagcctctttcagtcccaggggtgaggtgctgggtgggtgcgctccctgggggctgggtggggctgaggatgtgagcgaacaaaccagacctagaaaaaaaaaagacagagatggaagcagagatgaaggcccagagagaggggttcacttgcccagggtcacacagctcaggaatctgaacctggctcaaaccagcattcacttctctcaaggcccacccaagggctgcagtgcagtggcacaatctcagctcactgcaacctctgccttccaggttaaagggattctcctgcctcagcctcccgagtagctgggattagaggtgcgtgccaccacacccggctaatttttgttattttaggagagacgaggtttccccatgttgttcaggctggtctcgaactcctgacgtcaagtgatccacctgcctcggcctcccaaagtgctgggattacaggcatgagccaccgcgcctggccaggaacagtctttactgacatgtgtttagggccatcgcacttcccccgctcttcacgggaattctctcttcactggctccactcaggtgccttttgtgagacagaaattcaagcgatgaggacagagatacaaacccgggatgggaggctgtgacatctgcccatagaaacacaattctgtttctaggaatttatccttcaactcgctagtacacgctcttcaagacatactgaaaaaacatgaaggattagaacagtgggtgtcgaatgctaccatttgtcttggaaatcaagcaaaacgaacgtgggtatggttgccgacgcatggaccatctccagtggaacaaggaactgccaacgttgattgcatttgggagggagatgaagggctgggatggaaagagctttattctcagtgcctcatcttttggttgttttggattttacaacatgtgcatgcattgcctacacaaacaaagacactaatttgaaaaggaaaaggggagaagaaaagagggaggaaagaaaaggggccggtgtggcagctcacacctgtcatcccagcaccttgggaggccaaggcggatggatcacctgagatcaggagtttgagaccagcctggccgacatatactgaaaccctgtctctactaaaaaatacaaaaattagctgggcatggtggcgcacgcctgtagtcccagctacttgggaagctgaggcaggagaattgcttgaatctgggaggtagaagttgcggtgagctgagatggcaccactgcactccagcctgggcaatagagcaagactccgtccctaaaaaaaaaaagaaaaaaaaaaagaaaagaaagaaaggaaagggagggaagagctcagtgtgggagaagattgggggtgggagtagagaattaatggaggaaaaagatgtgggggacaaaagcaaggtgtgagaggtgttggcaatggaaactgaatacctgttgagaagagccaggagggggcgacatggctttgaatctcttggggctgtgagattatgtgaaatgtgagaagactggacctcagtggggtgcctgacatatattcaggttacacctcccacaagcaggtggggctggacaatctctgtcaaccctccagccaggacccaagtgtctccctgtacattacttttggttgttgttgagacaagaatctcactctgctgcccaggctggagtgcagtggcatgatcttggctcactgcaatctctgcctcctgggttcaagtgattctcctacctcagcctcccaagtagctgagactataggcgcctgccaccacacctggcaaatttttgtatttttagtagagacaaggattcaccatgttggccaggctggtcttgaactcctgacctcaggtgatccacctgcttcagccacctaaagtgctggggttataggtgtgagccaccgtgcctcgccctccacatgcattttgagagccagctctctgggttgctttgtcccaactcacccagccttctttgaggcttccccaaaccctgggagcatttgacattgcagactgagctggacaatcaagggagaggtcttgctgacctgtcggggctggtggagtcatcagagattgtctttatcctcgccttcttcttctccacctcctcaacttcccctcttcttctggggcaatcctggagggcttcttgtaggaggcctctcccaccatctgcccagctctttctttctaatcttgttcaattgtgggtaaaggcacagctagttgggagcttggggagtttgatggggacaggggatgcagggagagggaggggcagggaatgctctcagggtccaaatttccttccattctagggttgcctgtgctcatctgtctgatggcttctctctctccctctcatccctgcctcctctttcctacctctcctcctccccttgtctctgtctctgacattgcttctatctttcttttttaacatctgtctcttttgctttttatctttgcctgtctctcctctgtgtctctctccttatgtctccatcttggtgtgtctctgaatctctccgtatctctgcctcctcctccccacatctctccccacctcccttccctatctctgtctctctccacagtcaaaaaagccaagtttgatggtgcccaaggtaagtggcttctcttgctgtcctgtcccgtgttgtctgtctgtctgtctgtctcttggagagactgggagggggtcccagcccagacttagagttgggctttatgtcttctgagcatcaggagaggggtcagaagattaaatagggggaggggcagccattggcctggggtccctgcagtttgtatgggggtccccgggtctccccagccatccttggagagtctgtaaggggtggggcttgccctgagccagtggctcttcccagggtcctaagaggtagaatggggactcttagatggggctacaggtgggaaaaatgaggctcagagaggcgaaaggagtttctttcttttcttcttcttcttttttttttttttttgagacagagtctccttctgttgcccaggctggagtgcagtggcgtgatctcggctcactgcaacctctgcctctgggttcaagcaattctcctgcctcagcctcccaagtagctgggattacaggcgccctctaccacgcccggctaatttttttatttttagtagagatggggtttcgccatgttggccaggctggtctcaaacttctgaccttaaatgatccgcccgcctcggcctcccaaagtgctaggattgcaggcgtgagctaccgtgccctgcctttttattattattatttttatttaaaatttttattttttgaggctggagtgccgtggtgcaatcatgttttactacagcctcaacctcccaggctcaagcaatcctcccacctcagccttccaagtagctgggaccacaggcgtgcaccactgcacccagctaattatttttttgtattttttagtagagatagggttttgccaagttgcccaggctggtcttgaactgctgggctcaagcaatcctccccccttgacctcccaaagtgctggcattataggcgcgagccactgcacccagcctgcaaagggggtttcttacagtcaattttgttccccttttctgggacctcagtctttttagctgaaaaccaatggcatggtcatttcgaagcagctggatgaagtatcccaaaattccacgtctccccacactgaggcccctcccttgtgccctgagggtggggttgtgggttagggggtgagtggcccagaaattcctgaggggatcacagcagatggtctagagcttgggaaggggcattggagagtccctgagccccagcgctgacccctactctcactgccacagagaaattcaacacgtacgtgaccctgaaagtgcagaatgtcaagagcacgaccatcgcggtgcggggcagccagcccagctgggagcaggatttcatgttgtgagtctgcagcgtctggcatgacctcactccctggcatagcccagcacctcgctggcccctcagggcagagctggacactggggaatcccgggtgactcccctctgtcctccctcttcccctgtccaccttatcaccttcacctccaaaacacatccccaatccaatcacttcccttggtctccgcagccaccagccaagtccctgctgcccgccagcctccgccctggcctcctgtgccatccacctcctacaatctgttctcctccaggcagccagggggatatttttaaaactgcaaatcacatcctgtcgctcccatgttccaaacttgtccgtggctcatcgacctcacaataaaacccacagccttccccgtgattcccaccaggttctcgctctatctccctcacctgccccagccacacccacctctgcccctttctccaacacttcccagcttgttcttgccccagggcccttgcacttgctctcctgtccccagctggctcttctccttcaggtctcagcttgtgtcacctcctcagtgaagccctccctgaccactacctccaagctacaatttcagggcatcatgccttcccaggccttgccaccaattttgtttgtttgtttgtttgttttgaggcagagcctcactctgttgcccaggctggagtacagtggcataatctcggctcacttcaacctccacctcccaggttcaagtgatcctcctgcctcagcctcccaactagctgggattacaagcgtgtgccaccacacccggctaatttttgtgttttaagtagagatggtgtttcactatggtggccaggctagtctcaaactcctggactcaggtgatccgcccacctcagcctcccaaggtgctgggattatagatgtgagccaccatgcctggccaatggaatttttttccttttttttttgttttgttttgagacagagcctcactctgtggcccaggctggagtgtagtggtgcaatctcggctcactgcaacctctgcctcctgggttcaagctattctcctgccttagcctcccgagtagctgggactacatgtgcgtgccaccatgcccggctaatttttgtgtatttagtaaagaccgggtttcaccatgttggccaggctggtcttgaacttttaacctcaggtgatccacccgcctcggcctcccaaagtgctgggattataggcatgagccaggagccaccaatcccagccaacagatatatatatcagatatatatatacttttttttttttttttgagactgagttttgcttttgttgcccaggctggagtgcaatggcgtgatctcggctcaccgcaacctccgcctcctgggttcaagcaattctcctgcctcagcctcccgagtagctggaattacagacatgcaccaccacgcccggctaattttgtatttttagtggagatggggtttctccatgttggtcaggctggtcttaaattcccaacctcaggtgatccgcccatctcggcctcccaaagtgctgggattacaggcgtgagccaccgtggttggccatattttaaaaatatatttcttaagataaatctttggtaaactgtaaattcagtgaatctcacatttcaccaagtttcctgctcccccgaattcacatatgtctagggcgaggcctgcagggaaagtgctttgaggtgggatcgtgtcctcacatcattagatggggatgacactgggaaggacagaggtgacccgaatgtccttatcctgtaggtaaagggagctatggagggtatttgagcctcttcctcacttacccagcatggtcagtgttggagggcccaaggaagggctcagaaagatgaaggtgcaggcgatgtgtaacatctgtccccacgccatccttcccggctttgaatcctggttcttttgtgataccccgagctcttaacttcccccactggcctcagtttcccctctataaaatgagaaccaccatgttaccctaccacctaggacactcccaggcctaggtttgaattgcagtatgctgtgtgttctcaggcgaatcaactaaactccctgggcccccgtttcctccctcctgctccctcgacgccccctctcctttttctgcagcgagattaaccgtctggatttgggactgacggtggaggtgtggaataagggtctcatctgggacacaatggtgggcactgtgtggatcccactgaggaccatccgccagtccaatgaggtgagtggcgggtggcctgagggtgaagaaggaggagtgccttgcagaagcccagagaccagtggactaaacaagatgggcatttatctcctatcccctgacaacatcaatgtagacacttgggattgccacgaaccttccaaagtcactagagcctatacaccttccatcttgctctgcctctctctccatgtggcttccaccttgtggccccaaatggctgctttaggctcaccattgcatcttcattccaaccaccgaaaggtgctggtggtgggggaggggggtggttcatgcacatctcattggccagaacttagacatgtggccaacaccttgctgcaagggattctgggaaatgtagtcctaggctggaaaatgtagtcctgggctgtgcttccctaggcacagctaaaaatgtattaccttggaaggagaaaagggataatataggcaattagcattttgtgtcccagatgggcagcagcaggaagcttacaccaactcataagaaggtgctaggtaacaaccctggcccctcagcctgtgcatcattgtcagcaggtagtagtgatgtctattttttatttaattatttatttttgagacagggtctcactctgttgcccaggctggagtgcattggcatgatcatggcccactgcagcctcgacttcccaggctcaagtgatcctcccacctcagcctcctgagtagctgggactgcaggtgcatgccaccaggccccccttattttttttgtatttttaatagagacagggttttgccatgttgcccaggctggtttcgaactcctgggctcaagcaatccacccacctcagcctcccaaagtgctggtattacaggtgcgagccaccatgccaggccgtggtcatgtctattcatctgtccccacagcccaatccctggcctcctaacctcaagtctcaacctctccatgctgaccccaggaaggccttattagctggagctctgatctgtcctcccctgtccatctgccttgggaggcccttcagatggcacctgcccactagcctcatctccccccacactctaacctctacccctcccagattccaccctctgaacctttgcatagtgtgttccctgagcttcaagtgtcctcctttccatcaccttctaaattcccatgtgcccacctccaggaagccctctctgacttctctctagatcctttagccctccttcctccctctgggctatgacctcatggggctgggggtgcctgtgtccagccctgtttccaagggctatgggctctcaggagccagggtgatgatggctgggcctcttggggaccctggcatcacccaatatgaaccaggcatagaggagggactggggactgttttttgtttgttcgtttttgtcattttattttattttattttattttattttattttattttattttattttattttactgtgagatggagtctcactctgtcacccaggctggagtgcaatggcacaatcttggctcactgcaacctctgcctccctggcttaagtgattctcctgcctcaacctcctgagtagctgggattacaggggcctgccaccacacccaactaatttttgcatttttagtagagatggggtttcgccatgttggccaggctggtcttgaactcctgacctcaagtgatccgcccaccttggcctcgcaaagtgctgggattacaggtgtgagtcaccgcacctggccagtgagtgtttgtttttgaatgaatgaatgcagagggacgaaatggttgcaacaatctaggtaagcgagtctaaaaggaagccttggctgggcatggtggctcacacctgtaatcccagcactttgggaggctgaggcaggtggattgcctgagctcagcagaccagcctgggcaacatggtgaaaccccgtctctactcaaaaatacaaaaaattagccaggagtgctggcacgtacctgtaatcccagcagctcaggaggctgagttaggagaatcacttgagcctgggaagcggaggttgcagtgagctgagatcacgccactgcactccagcctgggtgatagagagactctgtctcaaaaaaattaaattaggccgggcatggtggctcatgcctgtaatcccagcactttgggaggccgagatgggtggatcacgaggtcaggagattgagaccatcctggctaacacggtgaaaccccgtctctactaaatatacaaaaaatcagccaggcgtggtggcgggtgcctgtagtcccagctactcgggaagctgaggcaggagaatggcgtgaacccaggaggcagagcttgcagtgagccgagatcgcgccactgcactccagcctgggcgacagagcgagactctgtctcaaaaaaaaaaaaaaaagaaaagaaaagaaaaaagagagagaaaggaaggaaggaaaagaaaggaataaaggaaggaagggaggaagggaaagaaagaaaggaaggaagcagggagggagggagggaaggaaggaagggaaggaaggaaggacggaaggaaagatagagaggggacatgactttggttttggggtaggggtgagggggatgtctcatgcgagagtaggggccctggggactagtgaccagcagattcctgacccacacacctcctcccccaacccccaggagggccctggagagtggctgacgctggactcccaggtcatcatggcagacagtgagatctgtggcaccaaggaccccaccttccaccgcatcctcctggacacgcgctttgagctacccttaggtgagtacaggggcccgggaccttcacccagccccagccccagttgtggactcactcagctattccaggagagtgaacaggcctgggtaggtctagctgacccttcaggctgagaatgagggtccttcgccccggaggagagagagtttcttgggttgcagagaacagggatgtgaacctgctgggtgcgggccatgacctgggccccgtagcttcccagtgagctgcaagtgcttcacgaccgagggcgttcagggttgagctatcctggctgttccttggtgatgcctgagactgcaacagtgaactggggataggaggagagacagacagagacagagagacaaagagagacagagagagacatgtagacagaggctgagaacagatagtcccctcttcctttcctggaagcaccttgagtctctccacctcattcttctaagaacccatggctggccaggcatagcttctcatgtctgtaatcccagcactttgggaggccaaggggggaggatcatttgaggccaggagtttgagaccagcctgggccatctagtgagatcccatctctatgaaaaagttaaaaattcaccaggcatggtgctgggtttctgtagtcccaactatttgggaggctgaggcaagaggatggctcaagcccaggagtttgaggcttcagtgagttgtgattgtgccactgcactccagcctgggtgacagagcgagaccctgtctctaaaaaaataaaaataaaaacaatgggctgggcgtggtggctcatgcctataatcccagcactttgagaggccgaggcagatggatcacctgatgtcaggagtttgagagcagcctggccaacatggagaaaccctgtctctactcaaaatacaaaaaaattaactgggcatggtggtgcacacctgtaatcccagctactcgggaggctgaggcaggagaatcgcttgaacccaggaggtggaggttgcagtgaactgagattgtaccacttcactccagcctgggcaacagagtgagactccgtctcaaaaaacaatttaaaaattaaaaaattaaataaaaacaatggcttccccaccctcgtaaaggctaggaaccatctcctgtcatcctccaactattctccattcagctctgggaagaggggcgtcagaggcaccacggtacctccccttcatctccatccaccctcctgagaccgcagaccaacccacccctacttctgaggctttgccaaagaccccagaagccagggcccgggtggagctcagtaggcctggaggatggaggctgagcggcagggagggtcttccaggctcacagacagggctctgcttgcagacattcctgaagaggaggctcgctactgggccaagaagctggagcagctcaatgctatgcgggaccaggatgaagtgagtgttggggtgggaggggactgtttcttccttgtttctgtctctgtctccccatgattttcacttacagatgctgtttctctctaagcttgtctttccctgcatctctgtttctaactctttgtaacctgactgcatccatgacccatgtggtccagtctctagacaatgatggggtcaagaaacacacagaggccaggcgcagtggctcacgcctgtaatcccagcactttgagaggcgaaggtgggcagatcacctgaggtcaggagttcaagaccagcctggtcaacacagtgaaaccccgtctctactaaaaaaaaaaaaaaaaaaaaaaaattagccaggcttagtggctcacacctgtaatcccagcaatttgggaggctgtggcgggcagattatttgaggccaggagttcgagaccagcctggccaacacggtgaaaccccgtctctactaaaagtacaaaaaattagctaggcatggtggcgggcgcctgtcattccagctccttgggaggctgaggtgggagaatcacttgaatctgggaggcagaagttgcagtgagccgagatcacgctgctgcactccagcctgggcaacagagcaaggctctgtctcaaaataataatattgataataataataaaataaaaaattttacttttcatttggcggatacatgtgcaggtttgttacacgaatatattgcatgatgctaaggtctggaattccatggcattactcaaattgtaaacacagtacctaacgggtagttttttcactcttgtcctgctccctccttcctcccttctggagtccccaatgtctactgttcccatctttttttttttttcttttttgagacggagtctcgctgtgtcaccaggctggagtgcagtggcacgatcttggctcactgcaacctccacctcccgggttcaagtgattctcctgcctcggcctcccgggtaactgggactacaggcatgcgccaccatacctggctaatttttgtatttttagtagagacggggtttcaccgtttagctaggatggtctcgatctcttgacctcgtgatctgcccgcttcggcctcccaaagtgctgggattacaggtgtgagtcactgcacctggcccctagtcttttttctatctctgtttcttactttttctgtctctgtctctgtctctgtctttctctctctctctctctctctctctctctcgtgtgtgtgtgtgtctttctctccttttctctcttactccctgtatccttctcatagagagggagagaatttgggaggtagagggaagtcgggatgggacagaacagaggactatcctggtcccctggcctttggcccctctgagagaagccctttctccttcctccaccccttcagtattcgttccaagatgagcaagacaagcctctgcctgtccccagcaaccagtgctgtaagtacctcttgattcttccttgggtatcagctgaaatcctcatccctcccctaccccatgactgtcctgtctaaaggctcctccagtccggagatacaagtcctgagagtgcagtgtccacttacagtgtattagaaatcagcgttctgaggctgggcatggtggctcacccctgtaatcccagcactttgggaagccgaggtcaggagttcgagaccagcctggccaacagggcaaaaccccatctctactataaatacaaaaaaaatgaacaggcatggtggtgggtgcctgtaatcccagctactcagaaggctgaggcaggagaattgcttgaacccaggaggcagaatctgcagtgggccaagatcatgccactgtactccagcctgggtgacagagcaagactctgactcaaaaaaagaaggaaggaaagaaagagaaagaaagagagaaagagagagagagaaagaaagaaaggaaggaaggagaggagaggaaagaaagaaagaaaaagaaagaaaagaaaagagaaaagaaaagaaaggaagggaaggaaagaaaggaaaggaaggaaaggaaagagaagagttctgagacttgggcttgatgaaagacaagaaggaagaaaggaaggaaggaaggagagttctgagacttgggcttgattcccaccttgctatgtggtcatgggcaggccagtgtccctcttcgatatttaggggccctctctttgaaatagcgcatctgacagccccctcactctgagggctgttggaaggatctgggacatctagagacatgaaaaacacttcgtagatgcttcacttccattcatcagatcctggatgagggcgtataactcattccacaaactattcatggggccagcacaaaccccgagcagcccacgtcagatggtgcagacagacacaggcagaagatcctgccagcacatgtacaatgggcgcacgtacaacagacgaaggctgtttcactaacccattttcttagatggagaaactgaggcccaagaggagatgtgatttacccaaggccacacacccggcaactggcagagccaggatttgaacccaggtctgagggactccaactttgcttccctttccactgcaccttgtctgttaatgatgatgatgatcacgttcctcttcctatttccatcaaggctgcagttgtcaagattttttatcttcctgggccttgtggacactcagatgcatccagaccaggtcttttcatggatggaggagctgtctccctccttaaaatgacttcccattgctctgtggtggaggggaagtagcaaatcatatagcctcagggcagagctcccacctgctgacaccaaaaccccactgcactctttagcctccttctcctttcccatttactttcttttcttcttctctttttttttttcttggagatagagtctccctctgtcacccagactggactgcaatagtactatcttggctcactgcagcctctgcctcccggatttgagtgattcttgtgcctcagcctcttgagcagtggggattacaggcacatgccaccacgcccagctaatttttgtatttttagtagagatggggttttgccatgttggccaggctggtctcaaattttttacctcatgtgatctgcccacctcagcttcccaaagtgctgggattacaggtgtgagccaccatgcctggcaccttttccatttgcttttccatcttccttttctcccctctcacagctctccctgtatctgtgtctccctcaccatgtgtccaggagggtggtaatggaaccggggttgaggagggcttgggatactccagctggggtaccctgtttccacactaacttggggagtgatattgagaaagttccttggcttccctggccagggaggggtcatcactgcctggaaggaattacaaacccccgcttggtgaatggggtcattgagaggttgcaatgggggcggggccaggcagagtggaggcaggaaggcaatggcagagagcccctgggcagatggactagagctaggggcaggttcattttgggaagtggagaccaccactcagtatttacccacaagtcctcccttggagtattttgtcaccctatttctcagagaaagcagccaatggtcagaggagccaggattctggtccaggacatttttctgaagtgccaggtactgcacgtgataggcaaaggtggttctcgccctggccctgatgcgcagaggctctgtgactttgggctgctcactccatccctctgagccccatagtttcacccataaaatgagtagaatgataaaatccacccaacaggggtgtttcaaaccttagggtttccaatttagtgtgtctttccttatccaagagctgggagaggaaaagggtggagactgggagactgctaaccctagacatcatagtcagaaaaccctgggcccaaatacccactttgttacttcctgactgagcctttcctctcattgaaaactgagccaggcacagtggctcatgcctgtaaatcccagctactcggcctcacttgagaccacgtgtttgagaccagcctgaccaacatagcaagatccatctccacacaaaaaaacaaaaagaaaaccaccaagaaccaaaacattagctgaacatggtggtgtgtgcctgtaatctcagttactcaggaggctgaggtgggaggatcacttgagcttggaaattggaggctgcagtaagccgtgattgcaccactctactccaggctggatgacagagtgagaccgtgtttcaaaaaaaaaattaaagaaaagaaaaaaataaacaaacagggatatcccaccttcctcccaaggtggagagcagagacacagcaagtgtcagcaatgaaggtgatactcagggaaggtactcaggacaagagggacttttggggtggggggagcagttggggagagtgaggacagcaggggagcccccttcctacacccacccctctgtctgctcccttttattatttctgccccttctctttgtaggcaactggaattattttggctggggtgagcagcacagtaagtactcagcctgattgatgttctgggagttacatgggaaggtgggcaccttggtgatcccaaggcccctccccactaccacacagggaagcaaggagcctgtgacgagcacgtgggggccagagggctcagcaagacccctttcaagctttcctgtaccctgttcattagtgcctgtcttgggaggcctgccatctgctggggagtgggcaccgtcattggggtggggtggggggggttagcctggaggagtggacatttagaccaacaacctgcttgtctccagctgggcactgtgacccccgcaccccactccgccgtataacctcacctcctctcctgtagcccctgccttttggtcttcctatcttccttctccacttggaaatgtgtccagtgtcactcagagggtagtgggtgggcggggtctctaacagaacggcaggccagggacctcagggagatgcacacagggacctcagcaccccccaggtccacccacactcacacctcaccttccaccttcatttgctctcccagggaataaggcaagccaccccctccctaaattaaatgtccattttccttttcctttttttttttttttttgagacggagtctcactctatcacccaggctggagggcagtggcacgatctcagctcaccgcaagctctgcctccagggttcacgccattctcctgcctcagcctcccgagtagctgggactaaaggcgtccgccaacacgcccggctaattttttgtatttttagtagagacggggtttcaccgtgttagccaggagggtctcgatctcctgacctcgtgatccacctgccttggcctcccaaagtgctgggattacaggcatgagccatggcacctggccctaattaaatgtccgtttttctacctaacagcggttcccaacctttttgacacaagggaccagtttcatggaagacaatttttttatggactggggttgggggatggtttctggatgattcaagttcactgcatttgttgtgcactttatttttattattattattattacattatagtatgtaatgaaataatgatacaactcatcatcatgtagaagcagtgggagccctgaacttgttttcctgcaattagacagtcccatcttagggtgatgggggacagtgacagatcatcaggcattagattctcataaggagcacacaacctagatcccgcacatgcacagttcacagtagggttcacgctcccgtgagaatctttttttttttttgaaacagagtcttgctctgttgcccaggctggatggagtacagtggcgcaatctcgcctcactgcaacctctgcctccgagttcaagtgattctcgtacctgagcctcccaagtagctgggattacaggcgcgtgccaccatgcccagctaattttttgtatttttagtagagatggggtttcaccatgttggccaggctggttgtgaactcctgacttcaggtgatccacctgccttggcctcccaaagggctgggattacaagtttgagccactgcgcccggccttctatgagaatctaatgctgccgctgatctgacaggaggtggaactcaggcggtaatgtgagtgatggggagcaactgtaaatacagatgaaacttcactcgctcacccaaccgctgcccacctcctgctgtgcgccccagctcctaacaggccacagaccagatccatgccctaaagagttgctccctttctcccataccccgcctcttctagagaaatccagtcctctattctttctttccttctttcttttttcttttttttgagatggagtcttgctctgtcacccagactggagtatagtggtgcgatcactgctcactgcaacctccacctcccgggttcaagcagttctcttgcctcagcctcccgagtagttgggattacaggtgcacgccactatgcctggttaatttttgtatttttagtagagatggggtttcaccatgttggccaggctggtcttgaactcctgacctcaagcaatcctcccgccttggcctcccaaagtgctgggattataggtgtgagctaccatgcctggccagtcctctattttgaggataaatctgcctccttctctctccttcaactggggagtccttcactccttcctcatatcctggtggacaaacctaactccaggaccagtgaaactgttgacaaacactttggtccaccacaatttatcaaaaacaagttggttaaaaatcaacttaggccagccacactggctcacacctgtaattccaacactttgggaggctgaggcgggagggacgcttgagctccaaagtctgaaatcagcctgggcaacagagcaagactccatctctacaaaaaaaaaaaaaaagggccgggtgtggtggcacgcccctgtagtcccagctatttgggaggctgaggtgggagggttgtttgagcccaggaggttgggactgcagtgagccatgattgtgctactagactttagcctaggcaacagtgtgagaccctgtctctaaaaaataaatagattaaaataaataaataaaatcaattttgccaaaatgaatgcttggcagacagggcaagctcgataacaaccaacttgccacaaacgaacagtacggtcaaaagcaaagatagaccaggcgtggcagctcacaccataatcccagcactttgggaggccgaggtaggcagatcacttgaggtcaggagttcgagaccagcctggccaacgtgacgaaaccccatctctactaaaaatacaaaaattagccaggcatggtggtgcatgcctttaatcccagctactcgggaggctgaggcaggagaatcatttgaacctgggaggtggaggctgcagtgagccgagatcgtaccattgcactccagcctgggtgacagagcgagactctgtctcaaaaaaaaaaaaaacccaaaaaccaacaaacaaacaaaacaaaacaccaatgcagctaaagctgatagataattgggtcaaaaaggaaagacaattgaaccgaaaacagaccgttgggttaaaacaaaagtggttgaaaatagccagaagcaggcaatttagtcaagagctacttagtagaaagcagagcctgggcaaaagcaaaaagaatccaactcaaagtaatttacccttcataagcagataatttgtcaggaaaaaaaaaaactgggtaaacatgtgcacagcctcatgcaatttggctggaaacatctcagcccggtcaaggacaattggatagaaagaatgctggccggccgaggtggctcacggctaatcccagcactgtgggaagctgaggcgggaggatcgcttgagcccaggagttcaagatcagcctgggcaatatagggagatcccatctctacaaaataataaataaataaaattagctgggtgtggtggtgtgtgcctgtggtcccagctactgtggaggctgagatgcgaggatctcttgagcccaggaggtcgaggtttcagtgagttttgatcgcgccactgcgctccagcccaagtgagagagaccctgtctaaatgaatggatgaatacagcaaaagtctgaaggtttcactcattgctctgagattttggggtctgggggttttttcatttttttacatcctcttccccttacccgtacttctcatgttttcttcatggactactttttctttttttctggatacagggtctcattctgacacccagactgcagtgcagaggcgtaatcatagctcactgctacctcgacctcctgggctccagcaatgctcctgccataccctcccgaatagctgggactacaggcgcccaccaccacgcccagctaatttttaaatttttttaaagagatggggccttactatgttgcccaggctgatcttgaactcctgggctcaagtgatcctcctgccttggcctcccaaagtgctgggattacaggcatgagccactttgcctggcccatggactaggttttactttacttttattttattttattttttggagacagggtcttgtgtcacccagcccctggagtgcagaggtgtgatcttggctcacagcaatctccacctcctgggttccagagattctcctgcctcagcctcccaaggagctgggattacaggcacatgccaccacacctggctaatttttgtatttttagtagagacagggtcttggtatgttgcccaggctggtcttgaactcctggcctcaagtaatctgcccgcctccgcctcccaaagtgctgggattacaggtgtgagccactgtgcccggcctttgctttacttttaaaataaagataactttatcattctttttagttaaaaaattaaaaagattgcattattgaaatcttttttttcagaaggtacagaaaagaataaagaagaaaatgtacaatccccaattatgccaccacccagacatgttgcttttagaattggaatttttttttttaggatttagaaaacaaactgttcttttttctaaggaaaccaaactaaaccaaaatatcttttagttcttattaaacatgaagtttggcaactctaccacattccattttagcaatagattccaagtgtgtggtggctttgccaagctaagaatctaatcctttttgaaaaagacagaaccatgtctcagcatcttcttggttcttgcatatttgttaagttcaggtctggggtcgtcaccctcagatatcaggaaatctctaagggttaaagagcgttccgtccactttgaactcctgatcttcttccaacttccccctgactgtctgtgtgactcctgttatgggaaactaactgctcagtggaaaaaaatcccatgtcattttcagagatcctgaccttcagcaaagttgttcttcacatttgagctgaaggatgccctctactctgtccctgttttcttcacattgtaggtcctaccctagcccctagactttaggtccaatttgacccacataaagcaaagcagggttttcacctcccttgttctgaagcctatatctctattaacatgacccacaattctttatccatactagtaaaaaattctcttcttcggtagcggcaccgtaagtctgggaaattgtattggctcccatcatgtgcactctctcttcctcaccctcttcccataccgcctctctcttccagacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcaggtaggtgctgcggagtgcagcatgcatgtgggtcctgctgtgtctcctggagtggagagaggggtacggggctggacagagctggaggtggagttccagaagggcagaattcacccatccaggagggcagaattcacattttcttgtgggaattaaccatttttttctttttttttttcttttcttttttttttagacagagtcttgctctgtcacccaggctggagtgcagtggcaccatttcggctcactgcaacctccaccacccagactcaagcgattctcctgcctcagcctccccagtagctgggactacaggcacaggccgccacaccaagctaatttatttttattttttgtggagatgggggtcttgctccattgcctgggctagtcttgaacccctttttattcctatagcatcctcgaggctggccagggaagagggtctcaggcgctaagattggaggaggtatctaatcgggaaatgataaggttcgttgaatgactaagtgaatggttagaagagggctgagtggtggcccctatgtccccctgcctgtatttagacagagacagatattgctgttgacgttgagcacgatcctgggttcacataagcagcacataacagagggcctgacctggccagacagtggggggcatttgcacaagtaagtgatgtttcagtgggtaccagagggtgggtaggagtttgctagataaagcagacaaggaagagaccacggcaagtgcacaggtttatggtgttggagagacaacgaggtggccagcgtggccggaatggaggaggcggggagaagtggagggaggtatgcagggggagtttggagcgtatgggccacacagggctagcacagattttattccaaggcactagggagccatggtaggatttagagcaggggagggaggtgattggatttacaattccctgtggcttccaagggaagcaggaactgtggagacagcatctggtagagacagcagaggctggcctgggttggggcccggggtacggggaagtggatgcatttcccatactttttccaggtggaggacaggagacctgctgcggggctgtggtgatggcgctgaccctgagttcccagcacagtcaattgcctgttccccacagaccgcaaatgccacaaaagtgggaatttttttttttttttttttttttttgagacggaatttcgctcttgttgcccaggctggagtgcaatggcatgatcccagctcactgcaacctccacctcccgggttcaagtgattcttctacctcagcctcccgagtagctgggattacaggcatacgccaccatgcgcagctaatttttgtatttttggtagagacagggtttcaccatgttggccaggctggtcttgaactcctgacctcaggtgatctgcccacctcagcctcccaaagtgctgggattacaggcgtgagccaccgcacctggccaaaagcggggatttttgtcttttctgatcatggctgtgttttccagcccctagagcaggacctggcacatcgtaggtgctcagtcggtgatgagtcaatgcctgtgtgactggggctcaggtgggcagtgactcggtaccccagtccctgaaccctgttccatccccacagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagaggtaacaggacggggccaaggggccagaggggctgccacaaggtcacagggtcagcagggctatgatggggtcagcgtggacctgggaagttgctggggctgaagttgtcacaggctcttgggtttcttaaagggatcagaggtgacagggcagagtagggaggtcaaagagggttcaaggggccgtgaaggagacttagagtttgtgatcttagtggttgctggggtcggagaggtcaagatcctgggcaaatggggggccagaggggctgggctggtgaaaaggaagccgagga

SEQ ID NO: 319 - DNA, 32306 bp, Macaca fascicularis
  source 1..32306: mol_type = genomic DNA
gccacgtcaggcgctgtccgcgcccccggtgctgaaccaagatggccggtggcggccgggccccggcgtgagccaagcgcgggctgcagccgggagatgccccagcccagcggccgctgagcccgacccgacagagccggcccggccgcctccggtccgcctgcgagcccggagacatgtctctgctgtgcgttggaggtaggaggcgaggctgggggtcggggtacccgtttggacgcgggctgggctcggggtccgcatggatgcggctcctagggggatcctgggggtggcccgagtccaggcggctggacttttgagaggggtagcccttgtcgacgcagcagggccccggaagggatgatccgtgtagacacggcagggctctcgggggtcctggtggccgctgctggaggggtcgtgtggatgcggctgaacgcggaggcccgtgtggacgtggacggggatccggggttctacctggaaacgatttagactggggcgtctgtgtagaccgggtttttagagggtcagtgaggaagagtatgggctgggtggtttgattgaagcctgcaggggtacttggaagggatctggtgttgtgggctgggttgcgggtcctcatggacgcggacccggctggaaattcgaaggagagtgcggcgggagggttctccaagccgtggggatgtaagatatgggtagaggggcttggccatcaggacatccacgagttctaggactctcccagccctgggtgtaaagaggactggagtggggggagtgtggagacaggagacccctcccaacgtccagagagggctgtgactgggggtctgggggcgcttttccagttaactctttggtctcccgagtgagggggttggaggaatggccagaaggtcttcccgctccctgccccctccggttctcccaaacacgtttcagggccttcttggcagggagcctacttcttggaagagcaatgtcccctggtccccctcccggcccatcctcacctcacccactttgcgctggagagagggagggagggagacgtggggtggcggggggagctattttggggccagaacgccatctgcacagaggcccacgcccaggcccacgctatgcgttggggttgggggagggagggagacgtgggaggggcatgaccccctaccccacacctttatggctctggggttggggagaagccagcccacccgaacccaggcgttctgggcactcctgtttgagaactcaagctctgggagaccttgggcggcaagggtggaggtggaccgccgttcaacgcttacagagctctgaacccctggttcttaaggactggggtccccccatcactcccacctacttcaagaaggctggggtgggggaaggggtgtgtcggccaagcctgagacggcaggcttcgggagacctggagcgacaggaagcgtgtgtgtgctgaactcctgctgcctggacccagggtgggcaggcctgggatccgggaaccgcccccgctgcccctcctcctccctcccctccccctcggccgcttcattcacaaaccctgccccgcccgcccgctccccgccgcggcggcttccgagtgcaaatcaggccgggatgggccggcgtggacgcgggtgttcttaaagggacaggggcctcctttctctaagctcgtttctgctggacggggctgggggtggtggaagaagggtccctagagtcaaaggtcaactctttcagcccctagcctccaggcttatggagttaagggagtagggaagtgaaggagacccctaggtggcctccaccgcctaggcctgaggacggaatgggaggagaacttgaatgtccagaccccctactgacctctccccctgccctaagtagccgggctcttagaggcggcactggaggaggttccgacgtgggtgttcctggcagactcctctgtcctctctcttctccccccagcatcccgccccaccccgcctcacatccttcaagttgggcttctctggaaggtttgcctagtggagtgaggggggtggggatctcacccttaactctgacgcaaacaggaggctcggctgcgggggtggcattaaggggggggcagcaggaggcaagagggatgaggcttccagaaacagagacgtggggggaggactgtgctggattctgtggaccttatagagagggacacagctgagtggagaggaattgctgggaggggcaaggctggggaagaggttgacgggggtgggaggtaaggccctgaggtgtaaagggaggtgtgaggttggagtgaggaggagtaggaggcagggaggggtggggagaagaagaagtgctgggtgaggccagtctcccaggaagaggtgggacggtgcccagagagaggaggggctgggatggttgagcaggagagatggggagtgttggggtgggcttggcaggagtaaagctaggctgagatgcgttgatgtgttgcctgagctcagttgaggaaatacctgccccgcctcccctccaccggggacccacaggcgtttgccaatccctacacacattcatacccagacttgttcctgtgtggacacaaacgcttaggatgcacgaaggctccacgcagaccacgtgcctgggaaggcgcattccataggcacacgtgtgtactcaaacgcctgtgtgaacacaagcatatacatgtatataggacacagtctgccactacagatatagtcctggcaacacatgtgtgagtgtgtgtgtgtgtctgccagcacgcatatagatgtatccacgtgtgtctgatgaatgttcacaatatacatgtcacataaagatccactcatgtccagctgagcgcagtggctcaggcctgtaatctcatcactttgactttgggaggccaaggtgggcagatcacttgaggtcaggagttcaagaccagcttggccaacatggtaaaactctgtctctactaaaaaaatacaaaaaattagccaggcttggtggcgtgctcctgaggaaggagaatcacttgaatatgggaggtggaggctgcagtgagctgagatcctgccactgtactccagcctgggcaacagagtgagactctgtctcaaaaaaagagattcactcatgtcctaacgctcagacatgtacccataaatatctgttaaggtccccaaccccatgaagcacacatatattcatataagcatatgtcaaagccatgtgtgtacgcacatgacaacacttgcctggacattcaaaccaccccctttcaacaagtggatgatgatgcatacaagtaaatacacatttgagtatttcattgcacacaagtgcatacatgtatgcatataaacaaatacagctgccacagaactgcatccatgtacacgtgcaaacatcaatatgtgtgttttccacctatcacccacaagctcacacacaccagtgtgtctctgatgtagtgacaccccactcccagacacacatgtgcagactcccacctgcactgaaatggtgcacataccctgcacacatgcacgctcatatccatgtacaggcaggcgcctgcctgctctggtaagataagccaactactgctgcaaatatccaagcaagtataggcaaatgcaagctcttgtgtatacacccagcaccaacacatagcagaccaccctgtatgattcatgggccttatttttgcccccttcatttacttatccacgtggagtcccgctgctccccaacattttaatccactcgcgaggtcctggcaggatcctgaggctgtgaatggcaaatgctacctggttccttcgtggagtcactcattttatttatgcaacaagcattaattgagcatcaactgtataccagccactgttcctggctctggggacccaaccctattcctattcaccacccatgcacctcccatggagttagaatgaaagaggtgagggagggctaagggagctgaggagtggggtatccagggctctcttcctctgggaagcctgccctgattgcaccaccaccaccatttatttgagtctcagaagatgtgatgagggagagattagcaggagggagatgatgctctgggtggagggaacagcatgagcaaaaccatggtggtgtgaaaggtcagttccagatcttcctatgtgcttcacagcattttgcacagaccacttgatgttttgttttgttttgagacagagtctcactcaaaacttgttactcaggctgcagtgcagtggcacgatctcagcttgctgcagccttgacctccagggctcaagcgatcctcccgcctcagcctcccaagtagctgggactacaggcatgcaccaccacacccggctaacttttatttttatttttttattttttgcagaaacagggttttgccctgttgcccaggctggtcttgaactcctgggctcaagtgattcgccctcctcagcttcccaaagtgctaggattacaggtgtgagccaccacaccaactgatgttttaaaggctctataaacattttatgaataaatgacatgaacaaatcagtgaatttaggtgagggcaggtttgcttcacaacttacaataatatcaacaacaaactccatttatccagcttttgtttgtttgtttgttttgttttttagagacacagtctcactgtgtcacccaggctggaatgcagtggtgtgatctcggctcactgaaacctccaccttctgggttcaagcgattctcctgcctcagcctcccaagtagctgggattacaggcatgtgccaccatgcccagctaatttttgtatttttagtagagatggggtttctcatttctactaaaaatacaaatacatctctagtggccaagctggtctcgaactcctgacttcaagtgatcctcctgccttggcctcccagtgtgctgggattacaggctcgagccactgtgcctggcccagcatttcataggcacaatgttgaggatttttatgcccatgccctctttaactctcacagtagccctattgtacagatgaggaaaactgagactcagggagctttaacaacttgcctggtgtaacaaagccagaggtggagctgactgactccagagcctactggggttggcagaagaaggttgagccttctgtcagcccccaggacctgggagacagccaagtcccttctgtggggtgaggatctgccctgggatagccttcttctatttatttatttatttaagagagagtctggctctgatgcccaagctggagtgcagtggcacaatttcagttcactgtaacctccgcctcctgggttcaagcaattctcctgtctcagcctcccgagtagctgggattacagatgcccaacaccatgcccagctaattttttgtatttttagtggaaatggagtttcatcatgttggccaggctggcttcaaactcctgtctgtcaagtgatctacctgccttggcctcccaaagtgctgggattacaggcatgagccaccgtgcccagtcaggattgctttcttctttcatgcatctagtaaacagacatgtcacaatctctccattcatcggtgctgttccactgccccttgcctaagaagccttcacacatccctctgttcctggctactcagtctctgataccctccaggtaggaggagctgcatctaggtcttagcttctaccgtcctcgtgggatgccctccagagttgcatcttcaggactgcagcctaaccctttccctaacctggcctcacttttcttccacacacaatgaacctcttctgcaaggtgccaataagggcattctgggtccagcacgcctgagtgtgaattcctaagtccaccacttcctgacaagtcctacatcctctgcattccttgctgtgctcatctgtggaatgggcacaggagtaacacccaccatctatgtttgtcagaactctccaatgaggcttgcagagcccttggcacgacgcccagcctacgggaaggcccaataatcatgagcaaaagacatgaaaaatcaatgatgggccgggcgcggtggcttacgcctgtaatcgcagcactttgggaggccgaggcgggcggatcgcctgagctcaggagttcaagactaccctgggcaacatggtgaaaccccatctctactaaaatacaaaaaaattagctgggtatggtggcgcgcgcctatagtcccagcctttcagggggctgaggcacgagaatcgctgaagccccgaaggtggagtttgcagtgagccgagatcgcgccactgcactccagcttgggctacagagtgagactccttctcaaaaaaaaaaaaaaaaaaaaatcagtgatgatgttttcattaatggggactaaaagctttctggaaggcggttctaagtgtaggacatttccgagagtccactgcattctgcggcctgaggagcgctccaagagacttccccaggcccactcgcaggagggagccaagttcattgagggtacaagggcggggaccgagcattcagcaccgtggacagcgcctgccggggccactgggggacagctcttagctcaacctcccagggctgctggaggaggtgacgtcattccttccatgaattactatttaatgagcacctactataggctaggcctagttctaagtggtacatggtaaacaacacacacagaaattcctgattcctgaagctctctggaactccatgttcttggtgttttttacactgaaggctcagtctggctctggtctatttgtgtcaacggaggataagggtcctcatttagtctctcccagatgcgaaaccagcagagctgaggtcttttatcctaaagcccatccatctcccgctgaaatgccctccaccaacatcacacacaaaacgatcaaatctcctagaatctatttctggattctctacgcttcctcccctccctcaagctaatcctggggcgggtgggctttcagaagccctagacagctggatctccacctcctgtctccccaccccattccacgtggcaggtcagggaacgagtgcccccaagagtccctggagtcccccttaattagaatcagggtcaatcagccatgtggttcatgcctgtaattccaacactttgggaggccgaggtgggaagatcacttgagccttgaaaccagccatggcaacatagtaagaccccatctctacaaaaaaataaaataaataaaataaaaaggaatagccaagcatggtggtgcgcacctgcagtctgtgttactcgggaggttgagtggggaggattgcttgagcctgggaggtcgaggctgcagtgagccatgatcatcacaccactgccctccagcctggagtctgggcaacagacagaaaccctgtctcaaaaaaaaaaaaaaaaaaaaaaaaaaggagagaaaagaaagaaaaagaaaagaatccagggtgttcaaatcctagaatccaggccagagacacctttagaacacaaccaaataataaaaacagtagtgataccagtaataataatagtagtatatacgacactacaatcatgattctgcagaaggggtgagggaagaagaggagggaagaagaggaggagaaagaagagggaagggaggtcagccactccgtctccccattttccagatgcagaaactgaggcgccgagccaggctgcaggggtgtcccgcagcctgaactcctgcttcagcctccggggttcagccactacattcatcagtcagcgctgctggggggccccaaagacctttgaggccgcatgacgcgctggggacggcagtgggcacccccctcgtccccgcccccctgcccgccggcgcgccgcccacgccctccgcgcgcccacgctataaatagcctcgtgcgtgtgacccgaagcccgctggagcccgctggggaagggtggtgcttccgccccgctgaccctgataccgcaacccggcgcgggcggggaggtggcgggatatgacgacgaagacggtgactcagggaccatttactgaccggggaagacggggagagagagtcggttccttctctgagcacccttcctcctccaagcccctccccctgagaccaccctcctctctgcgcctatcccctttcccgaatcccctcccccaccgcgaacccccttccctcctgaggaccctctctccactctcggcccccttccctgtccccttttccctctgagacccctctcccactcggagccccagcgatgaaaaatcgtggatgtcctcaccctggacctcggcagggcgctaagggccggagcctggcttcagctgtcagagggtacagccctccagccggtcccccactgcctgaggaccccaacggagatcattcccctccagccaagagaggctgcgggaaggagctgaggcttagggaagaggagccaattgaccaagggaggggcacaagaagggcagagacagtcagagagagaaggggagaacagagaggaaaagaagtcgaccagagtggagagaaatagaacagggaggagggagatgagagacagggatggggaaacagagagaggctcacacacacagaaaagatcaaggagctactgggctcccctctgagcctaaatccatggtttataaaacggggcacagttggaggagcttcaagtgagcccagctcaggctagaccccagtgaggcccccccagagcctgtcactttcccatccccatacgcatccccacccttctcccccaactgcctctcctctccccagtgtctcctccacctgcctgcccccccagtggaaatctttccctctctctcttttattaataataataaataatattattttattttattttattttattttttggagacagagtctcgctctgtcacccaagctggagcgcagtggtacgattttggctcactgcaacctccacctcccgggttcaagtgattctcctgcctcagcctcccgagtagctgggactacaggcgtgcaccaccacgcccagctgatttttgtatttttagtaaagacaggatttcaccatgttgcccaggctggtctcgaactcctgacctcatgtgatccacccatcacaggctcaaagtgctgggattacaggtgtgggccaccatacctggcctctttctctcttttaaattattagttttagacatgggatcttacgacattggctaggctggtcttgaactcctgggctcaagggatccttctgccttagcctccctagtagctgggattacaggcatgtgcctctatgcctggtgctctcgctgtctccttgtgtctctatttctctccatctgtccaggctctcctctcttgctttcacgcccatcatttcttcctctctcctctccctatatgagtccctccagctatgggtgcctttctcagcctctgtcagcgtcccctccacccccaaccccgtcaccattctccctcctgccccttcccctgcccacccctttcacagagagttcccacccctccagactggacctcctccaggagcctggcccaaagctcctgctgggctcattcctgagtgttcctgagcttctttcagtcccaggggtgaggtgctgggtgggtgcgctccctgggggttaggtggagctgaggatgtgacagagaaaaccagacctagaaaaaaaaaaaaaaaaaaaaaaaaagacagagatggaaccaaactgagatgaaccagagagagggattcacttgcctacggtcacacagctctggaatctgaacccagctcaaaccagcactcacctctctcgaggcccagccaagggctgcagtgcagttgcacagtctcggctcactgcaacctctgccttccagattcaagcgattctcccgcctcagcctcccgagtagctggtattacaggtgcgtgccaccacgcccggctaatttttgtagttttaggatagacgaggtttccccatgttgttcaggctggactcgaactcctgacgttaagtgatccgcctgccttggcctcccaaagtgctgggattacaggcatgagccaccgcgcctggccaggaacagacagtcttcactgacatgtgtttagggccatcacacttcccccgctcttcatgagaattatctcttcactggctccactcaggtgccttttgtgagacagaaattcaagagatgaggacagagatacaaacccgggatgggaggctgtgacatctgcccatagaaacacaattctgtttctaggaatttatccttcagctcgctagtacacactcttcaagacatactgaaaaaacatgaaggattagaacagtgggtgtcaaatgctgccatttgtcttggaaatcaagcaagacgaacgtgggtatgattgccgacgcatggaccatctccagtggtacaaggaactgccaacgttgattgcatctgggagggagacgaagagctgggatggaaagagctttattctcggtgtctaatcttttggttgttttggattttacaacatgtgcatgcactgcctacacaaacaaagacactagtttgaaaaggaaaaagggagaagaaaagagggaagaaacaaaaggggcaggtgtggtggctcacgcctgtcatcccagcactttgggaggccaaggcagacggatcatctgaggtcaggagttcgagatcagcctggccaacatatagtgagacccagtctccactaaaaaatacaaaaattagctggcccgtagtcccagctaaattgcttgaacctgggaggtagaagttgcaatgagctgagatggcaccactgtactccagcctgggcaacagagcaagactcggtccatcaaaaaaaaaaaaaaaaaagaaagaaaaagaaaaaaataaaggaaaaggagggaagagctcagtgtgggagaagattgggggtgggagtagagaattagtggaggaaaaagatgtggaggacaaaagcaaggtgtgagaggtgttggcagtggaaactgaatacccgttgagaagagccaggatggggtgaaatggcttatgaatctcttggggctgtgggattatgtgaaatgtgagaagactggacctcggcgggggcgcggggcggtgcctgacatatattcaggttgcacttcccacaagcaagtggggctggacgatctctgtcaaccctccagccaggacccgggtgtctccatgtgcattacttttggttgtttttgagacagagtctcactctgttgcccaggctggagtgcagtggcatgatcttggctcactgcaacctccacctcctgggttcaagtgattctcctgcctcagcctcccgagtagctgagactattggcgcccaccaccacacctggctaatttttgtatttttagtagagacagggtttcaccatattggccaggttggtctcgaactcctgacctcaggtgatccagctgcttcagcctcccaaagtgctagggttataggtgtaagccaccgcgccttgccctccacaagcattttgacagccagctctctgggttgctacgttccacctcacccagccttctttgaggctttcccaaaccctagaagcatttgacatcgcagactgagctggacaattgagggagaggtcttgctgacctgacagggctggtggagtcatcagagattgtctttatcctcgccttcttcctctccacctcctcaacttcccctcttcttctgggaaaatcctggagggcttcctgtaggaggcctttcccaccatctgcccagctctttctttctaatcttgttcaattgtgggtaaaggcacagctagttgggagcttggggaatttgatgaggacaggggatgcagggaggggacaggtagggaatgctctcagtgtccaaatttccttccattctagggttgcctgtgctcatctgtctgatggcttctctctctccctctcatccctgcctcctctttcctacctctcctcctccccttgtctctgtctctgacattgtttctatctttatcttttttaacatctgtctcttttgctttttatctttgcctgtctctcctccgtgtctctctccttatgtctctatcttgatgtgtctctgaatctctctgtatctttgcctttcttctccccacatctctcccgtctcccttccctatctctgtctctctccacagtcaaaaaagccaagtttgatggtgcccaaggtaagtagcttcttttgctgtcctgtccggtgttgtctgtctgtctgtctgtctgtctcttggagaaactggggagggggtcccagcccagacttagacttgggctttatgtcttcggagcatcaggagaggggtcagaggattaaatagggggaggggcagcccttggcctggggtccctgcagtttgtatgggggtccgcgggtctccccagccatccttggagactctgtaaggggtggggcttgccctgagccaatggctcttcccagggtcctaagaggcagaatggggactcttagatggggctacaggtgggaaaaatgaagctgagagtcgaaaggagtttctttcttttctttccttcttcttcttcttctttttttttttttttttttgagacagagtctccttctgttggagtgcagtggtgtgatctcagctcactgcaaactctgcctccaggttaaagcagcgattctcctgcctcagcctcccaagtagctgggattacaggcgccttctaccacgcccagctattttttttatttttagtagagatggggtttcgccatgttggccaggctagtctcaaacttctgatcttaatccgcccgcctcggcctcccaaagtgctgggattgcaggcgtgagctaccttgccctgccttttttgtattattattatttttattttaaatttttattttttgaggctggagtgcagtggtgcaatcatgccttactacagcctcaacctcccaggctcaagcgatcctcccacctcagcctcctaagtagctgggaccacaggtgggtgccactctacccagctaattattttttgtatttttagtagggatggggttttgccaagttgcccaagctggtctcgaactcctgggctcaagaaatcctcccgccttgacctcccaaaatgctgggattacaggcgcgagccaccgtgcccggcctgccaagggggtttcttacggtcaatgttgttccccttttctgggacctcagtctttttagccgaaaaccaatgacatggtcatttcgaagcagctggatgaagtatcccaaaattccacgtctcccggcactgaggcccctcccttgtgccctgagggttagggttgtgggttagggagtgagtggcccagaaattcccgaagagatcatagcagatcgtctagagcttgggaagggcattggagagtccctgagccccagcgctgactgctgctctcactgccacagagaaattcaacacgtacgtgaccctgaaagttcagaatgtcaagagcacgaccatcgcggtgcggggcagccagcccagctgggagcaggatttcatgttgtgagtctgcagtgtctggcatgacctgggcccctggcacagcccagcacctcgctggcccctcagggcagagctggacaccagggaatcccgggcgactcccctctgtcctccctcttcctatgtccaccttatcaccctcgcctccaaagcacatccccaatccaatcccttcccttggtctccgtggccaccagccaagtccccgctgcccgccagcctccgccctggcctcctgtgccatccacctcctacaatctgttctccaggcagccaggggaatatttttaaaactgcaaatcacatcctgtcgctcccatgttccaaacttgtccatggctcatcgacctcaccataaaacccaccgccttccccgcacttcccaccagcttctcgctctgtctccctcacctgccccagccacacccacctctgccccttgtctccaacacctcccagctcgttcttgccccagggcccttgcacttgctttcctgtccccagctggctcttctccttcaggtctcagcttgtgtcacctcctcagtgaagccctccctgaccaccaccccccgagctacaacttcaaggcatcatgccttcccaggccttgccaccagttttgtttgtttgtttgttttgaggcagagcctcactctgttgcccaggctggagtacagtggcgtgatctcggctcacttcaacctccacctcccagattcaagtgatcctcctgcctcagtctcccaagtagctgagattacaagcgtgtgccaccacacccagctaatttttgtgttttaagtagagatggtgtttccctatggtggccaggctagtctcaaactcctggactcatgtgatccgcccacctcagcctcccaaggtgctgggattacagacgtgagccactgcgcctggccaacagatttttttcctttttttttttttgtctgagacagagtctcgctctgtcccccaggctggagtgcggtggtgcgatctcggctcactgcaaactccgcctcccgggttcacgccattctcctgcctcagtatcctgagcagccgggaccacaggtgcccgccaccacgcctggctaattttttgtatttttagtagagatggggtttcaccgtgttagccaggatggtctcgatcttctgacctcgtgatccgcccgcctcagcctcccaaagtgctgggattacaggcatgagccaccgcacttggcctgattttgaatttttagtggaaacggggtttctccatgttggtcaggcaggtcttgaactcccaacctcaggtgatccacctgtcgcggcctcctaaagtgctgggattacaggcgtgagccaccgcgcccggacatattttaaaaatacattccttaagataaatctttggtgaactgtaaattcagtgaatctcacatttcactaagtttcctgctcccctgaatccacatatgtctggggcgaggcctgcagggaaagtgcttggaggtgggattgtgtcctcacctcattagatggagatgacactgcgaaggacggaggtgcccccaatgtccctatcctgggggtaaagggagctacggagggtatttgagcctctttctcacttacccagcatgatcagggttggagggccaaggaagggctcagaaagatgaaggtgcaggcgaggtctaacatctgttcccaagccgtccttcccggctttgaatcctggttcttttgtgataccccgagctgttaacttcccaccccggtctcagtttcccctctataaaataagaaccaccatgttaccctaccacctaggacactcccaagcctaggtttgaattgcagtatgctgtatgttctcaggtgaatgaactaacctctctgggccctcgtttcctccctcctgctccctcgatgccccttctcctttttccgcagcgagattaaccgtctggatttgggactgacagtggaggtgtggaacaaaggtctcatctgggacacaatggtgggcactgtgtggatcccactgcggaccatccgccagtccaatgaggtgagtggcgggtggcctgagggtgaggaaggacgagtgccttgcagaagcccagagaccagtgggctaaacaagatggacatttaggccaggcgcggtggctcaagcctgtaatcccagcactttgggaggccgagacgggcggatcacgaggtcaggagatcgagaccatcctggctaatatggtgaaaccccgtctctactaaaaatacaaaaaaaactagccgggcgaggtggtgggcgcctgtagtcccagctactcgggaggctgaggcaggagaatggcgtaaacccgggaggcggagcttgcagtgagctgagatccggccactgcactccagcctgggcgacaaagcgagactccgtctcaaaaaaaaaaaaaaaaaaaaaaaaaacaagatggacatttatctccaatcccccgacaacatcaatgtagacacttgagattgccacgaaccttccaaagtcaccaggacctatacaccttccattttgctctgcctctctctccttgtggcttccaccttgtggccccaaatggctgctttaggctcaccattgcatcttcattccaaccacagaaaggtgatggtggggagaaggggggtggttcatgcacatctcattggccagaacttagacatgtggccaacacctagctgcaagagattctgggaaatgtagtcctagactggaaaatgtagtcctaggtaatgcaaccctaggcacagctaaaaatgtattaccttggaaggagaaaaggggtaatgtaggcaattagcattttgtgtcccagatgggcagcagcaggaaggttacaccagctcataagaaagtgttaggtaacaaccctggcccctcagcctgtgcatcacggtcagcaggtagcagtgatgtctattttttatttaattatttatttttgagacagggtctcactctgttgcccaggctgcagtgcagtggcacgatcatggcccattgcagcctcgacttcccaggctcaagtgatcctcccacctcagatgggactgcaggtgcatgccaccacgccccactcattttttttttttttttttttttttgtattttcaatagagacaaggttttgccatgttgcccaagctggtctcgaactcctgggctcaagcaatccgcccacctcagcctcccaaagtgctggtattacaggtgcaagccaccacaccaggccgtggtcatgtctattcatctgtccccacagcccaatccctggcctcctgaccttaagtctcaacccctccatgctgaccccaggaaggtcttattagctggagctctcatctgtcctcccctgtccatctgccttgggaggcccctcagatggcacctgcccacgagcctcatcttcccccacacttcaacctccacccctcccagattgcagcctctgaacctttgtatagtgtgttccctgagcttcaagtgtcctcctttccatcaccctctaaattcccatgtgccctcctccagggagccctctctgacttccctctggatcctttagtcctccttcctccctctgggctagctatgacctcatggggctgggggtgcctgtgtccagccttgtttcccagggttatgggctcctcaggggccagggtgatgatggctggggcctcttggggacccttgcatcatccactatgaactaggcatagaggagggactggggactgttttttgtttgttcgtttcgttattttattttattttattttacttagagacagagtctcactctgtcaccaggctggagtgcaatggcacagtcttggctcactgcaacctccgcctccctggctcaagtgattctcctgcctcagcctcctgagtagctgggattacaggcaccctccaccacacccagctaatttttgtatttttagtagagatggggtttcaccatgttgggcaggctggtcttgaactcctgacctcaagtgatctgcccacctcggcctcccaaagtgctgggattgcaggtgcccgccaccacacccagctaatttttgtatttttagtagagatggtgtttcaccatgttggccaggctgatcttgaactcctgacctcaagtgatccgcccaccttggcctcccgaagtgctgggattataggcatgaggcaccacacctggccagtgagtgtctgtgtttgaatgaatgaatacagagagacgaaatggttgcaacagtctaggcaagtgagtctaaaaggaagccttggccgggtgcggtggctcacacctgtaatcccagcactttgggaggctgaggcatgtggattgcctgagctcagtagaccagcctgggaaacatggtgaaaccctgtctctactaaaaaatacaaaaaattagctgggcgtgctggcgcacacctgtaatcccagcagctcaggaggctgagtcaggagaatcacttgagcctgggaagcggaggttgcagtgagccgagatcacgccactgcactccagcctgggtgatagagtgagaccctgtctcaaaaaaattttaatttaatttaatttaaatttaaatatataaaaggaagccttgagggagacccaaaatttcctcagtggcccttcaagtgtgaggggggcctggtcacctggggcaacagaaagtggattccgccgaagatcattccatttgaataatgaacaaactgaggttcagggtgaaccccagttgctcaaaggctcacattcctgagccaggggaaatgggctcgttgtcctggggaactttctccctggatgctgggaggctccagggtttttatctgaagtcagagtctcataaccccttatcaggggtggggaatgaccatgccgggctgggactgcccttacataaccccaaggggctccccctctgggtcctttgctttgggttcccctgactcaccatgtggccctggactgagaccttctcctctctgagtcgcagtttcctcatgtgtaacatgggacatagccaggcacaatggcatgtgcctgtagtcccagctactggaggctgaggcaagaggatcagttgaggccaggagtttgagatgagcctgggcaacatagtgacaccccatctctaaaaagaaagaaagagagaggaagagaaggaaggaagggaaggagggagggagggagggaaagaaagaaagaaagaaagaaggaaagaaagaaagaaagaaagaaagaaagaaagaaagaaagaaagaaagagagagagagaaagaaagaaagagaaaaagaaagaaaggaaggaaggaaggaaggaaggagagagaaagaggaaagaaagaaagagaaagaagaaggaaggagagaaagagaaacggagggaaggaaggaaggagagaaggagggaaggagagaaggaaggaaggaagggagggagggaaagaaaaaagaaggaaagaaagagaaagaaagaagaaagaaagagaaaaaggaaggaaggaaagaaagaggaaggaaggagagaaaaaggaaggaagaagggaaggaaggaaggagagaaggagggaaggagggaaggaaggaaggaaggaaggaagaaaggaaggaaggaaggaaggaaggaaaggaagagggagaggagacacaacttttgttttggggtaggggtgagggggatgtctcatgtgagagtaggggccccagggaccagcgtagcagatgcctgacccacatacctcctccactgacctccaggagggccctggagagtggctgacactggactcccaggtcatcatggcagacagtgagatctgcggcaccaaggaccccactttccaccgcatcctcctggacacgcgctttgagctgcccttaggtgagtacccaggcacgggacattcacccagcccggccccacttctggactcactcagctattccaggagagtcaacaggctgaacctgctgcgtgcaggccatgacccaggccccgtaccttcccaatgagctgcaaatgtttcacaaacccacggcgctcagggctgagctatcctggcggttccttggtgatgcctaaggctgcaacagtgcgctggggataggaggagagacagacagagagagagacaaagagagacagagagacatgtagacagaggctgagaacagatagtcccctcttcctttccggaagcacctcgagtctctccacctcattcttctaagaacccatggctggccaggcacagtgtctcatgcctgtaatccaagcactttgggaggctgaggtgggaggatcatttaaggccaggagtttgaggccagcctgggcgatctagtgagatcccatctctatgaaaaagttaaaaattcaccaggcgaggtggctgctgggcgcaggtggctcacgcctgtaatcccagcactttgggaggctgaggcgggtggatcacgaggtcaggagatccagaccatcccggctaacatggtgaaaccccgtctctactaaaaatacaaaacaattagccggtctggtggcgggcacctgtagtcccagctactcgggaggctaaggcaggagaatggcgtgaacctgggaggcggagcttgcagtgagctgagatagcgccactgcactccagcctgaatgacagagcgagactccatctcaaaaaaaaaaaaaagaaaaagaaattcaccaggtgcctgtagtcccaactattcaggaggctgaggcgggaggatagctcgagcccaggagtttgaggctgcagtgagctgtgattgtgccactgcactccagcctgggtgacagagtgagaccctgtctctaaaaaataaaaaataaaaacaatgggcatggtggctcatgcctgtaatcccagcactttgagaggctgaggtggatggatcacctgacgtcaggagtttcagaccagcctggccaacatggagaaaccctgtctctactcaaaatacaaaaaattagccaggcgtggtggcgcatacctggaatcctagctacttaggaggcggaggcaggagaattgcttgaacccgggaggcgaaggttgcagtgagccacgattgctccactgtactccagcctgggcaacagagtgagactccgtctcaaaaaaaaatttttttaatttaaaaaaattaaataaaaacaatggcttccccaccctcgtaaaggctaggaaccatctcctctcatcctccaactattctccatccagctctgggaagaggggcatcagagacaccacagtacctccccttcatctccatccatcctcttgagaccccagaccagcccacccctacttcttttttttttttttttgagatggagtcttgctctgtcacccaggctggagtgcagtggccggatctcagcccactgcaagctcctcctctcgggttcacgccattatcctgcctcagcccccccagtagctgggactacaggcacccgccacttcgcccggctagtttttcgtattttttagtagagacggggtttcaccgtgttagccaggatggtctcgatctcctgacctcatgatccgcccgtctcggcctcccgaagtgctgggattacaggcttgagccaccgcgcccggccgcccacccctacttctgaggctttgccaaagaccccagaaaccagggcccggctggaactcagtaggcctggaggatggaggctgaggggcagggaggagcttccaggctcacggacacggctctgcttgcagacattccggaagaggaggctcgctactgggccaagaagctggagcagctcaacgctatgcgggaccaggatgaagtgagtgttgcggtgggagggggctgttttcttccttgtttctgtctctgtctccccacgattttcacttactgatactgtttctctctgagcttgtctttccctgcgtctctgtttctaactttgttaacctgactgcgtccatgacccatgtggtccaatctcaagacaatgatggggtcaagaaacatgcagaggccaggtgcagtggctcatgcctggaattccagcactttggggggccaaggtgggcaaatcacctgaagtcaggagttcaagatcagcctggccaacacagtgaaaccccgtctctactaaaaaaaaaaaaaaaaaaaaaaaaaattagccaggctcagtggctcacacctgtaatcccagcaatttggaaggccgtggtgggcagatcgtttgaggtcaggagttcgagaccagcctggccaacatggtgaaaccctgtctctactaaaaacacaaaaaattagctaggcgtggtggcgggcgcctgtttttccaggtccgtgggaggatcacttgaatctgggaggcggaggttgcagtgagccaagatcatgccactgcactccagcctgggtgacagagcaaggctctgtctcataataataatatagataataataataaaataaaaaatttattttccattcaggggtacatgtgcaggtttgttacatgaatatattgcattatggctaaggtttggaatttcacggcattactcaagtagtaaacacagtactcaacgggtagtttattcacccttgtcctactccctccttcctctgttctggagttcccagtgtctacagtttccatcgcttttttttttttcttttttgagacaaagtctcgctctgtcaccgggctggagtgcaatggtgcgatctcggctcactgcaacctccacctcccgggttcaagtgattctcctgcctcggcctcccgagtagctgggactacaggcgtgcgccaccacacctggctaatttttgtatttttagcagagacggggtttcactgtttagccaggatagtctcgatctcttaacctcatgatctgcccacctcggcctcccaaagtgctgggattacagatgggagccatggtgcccagcctactgtttccatctttatgtccatgagcacccaatgtttaggttgcacttataagcaagaacatgtgggatttggttttctgtttttggatagattcgctttatactggcctccagccacctccatgttcgtgcaaaggacatgatttaattcatttttatggttgtgtagttctccatggagtataggtaccacattaaaaaaacaaaaagaaaatccaagccgggcacggtggctcacgcctgtaatcccagcactttgggaggcagaggtggaaggatcgcctgaggtcaggagttcaagaccagcctggccaacatggtgaaaccgtctccactaaaaatagaaaaattagctgggcatggcggcatgcgcctataatcccagctactcgggaggaggttgcagtgagccgagattacgccactgcactccagccggggtgacagagcaagattctgtctcaaaaaaaaaaaaaaagaaaaatccaatccaccattgatgggcacctaggtttattccgtgtctttgctgttgtgaatagcactgccatgaacatacgtgtgcatgtgtctttttggtaggacaatttcttttcctttgggtatatacctagttgtttgtttgtttatttgtttgagacggagcctccctctgtcatccaggctggagtgcaacggcacaatctcagctcactgcaacctccgccgcccgggtttaagtgaatctcgtacttcagcctcccaagcagctgggcttacaggcgcgtgccaccacgcccagctaattttttgtgtttttaatagagacagggtttcaccatgttggccaggctggtctcagactcctgacctcaagtgatctgcctgtctcggcctcccaaagtgctgggattacaggtgtgagtcactgcacctggcccctagtctttttctatctctgtttctcactctttctctgtctctgtctccgtctttctctctctctctcacatctctgtgtgtgtgtgtgtgtgtgtgtgtgtgtgtatctttctctccttttctctcttactccctgtatccttctcatagtgggggagagaatttgggaggcagagggaagtcgggatgggatggaacagaggactatcctggtcccctggcctttggcccctctgagataagccctttctccttcccccaccccttcagtattcgttccaagatgagcaagacaagcctctgcctgtccccagcaaccagtgctgtaagtacctcttgattcttccttgggcaccagctgaaacactcatccctcccctaccccatgactgtcctgtctaaaggctcctccagtctggagatacaagtcctgagagtgcagtgtccacttacagtatattagaaattagcgttctgaggctaggcatggtggctcacccctgtaatcccagcactttgggaggccgaggtcaggagttcgagaccagcctggccaacagggcacaaccccatctctactaaaatacaaaaaaattgaacaggcatggtggtaggtgcctgtaatcccagttactcaggaggctgaggcaggagaattgcttaaacccagaaggcagaatctgcagtgggccaaggtcatgccactgcactccagtctgggtgacagaacgagactgtgactcataaaaagaaggaaggaaagagaaagagaaagaaagagagagagagagaaagaaagaaagagaaaaagaaagaaagaaagaaagaaagaaagaaagaaagaaagaaagaaagaaagaaagagagaaagagaaagaaaagaaagaaagaaagagggagggagggaaggaaggaaggaagggaagagttctgagacttgggcttgatgaaagacagggaggaagaaaggaaggaaggaaggaagaaaggaaggaaggaagggagagttctgagacttgggcttgattcccaccttgctatgtggtcatgggcaggccagcgtccctcttctatatttaggggccctctctttgaaatagtgcatctgacagccccctccctctaagggctgttggaaggatccaggacatctagagatatgaaaaacacttcgtagatgcttcactttccattcatcacatcctggatgagggcgtataactcattccacaaactattcacggggccagcacaaaccccgagcagcctacagtcagatggcgcagacagacacagacagaagatcctgccagcacatgtacaatgggcacacgtacaacagatgaaggctgtttcactaacccattttcttagatggagaaactgaggcccaagaggagatgtgatttacctaaggccacacacccggcaagtggcagagccaggatttgaaaccaggtctgagggactccaactttgcttccctttccactgcaccttgtctgttgatgatgatgatcacgtttctcttcctatttccatcaaggctgcagttgtcaagatttttttaatcttcctgggccctgtcgacactcagatgcatccagacaaggtcttttcatggatggaagagctgtctccctccttaaaatgacttcccattgctttgtggtggaggagtagcagcaaatcatatagcctcaggacagagctcccacctgctgacaccaaaaccccacttcactcttcagccaactccttctcctttccatttactttcttttcttcttcttcttcttcttttttttttttttttttttttggagatagagtctccctctgtcacccagactggactgcaatggtactatcttggctcactgcagcctctgcctcctgggtttgggcgattcttgtgactcagcctcttgagtagtggggattacaggcacatgccatcacgcccagctaatttttgtatttttagtagagatggggttttgccatgttggccaggctggtctcaaattttttacttcatgtgatccacccacctcagcttcccaaagtgctgggtttacaggtgtgagccaccatgcctaacccctttccatttgcttttccatcttccttttttcccccctcacagctttccctgtatctgtgtctcccccaccatgtgtccaggagggtggtaatggaggtggggttgaggggggcttggggaactccagctggagtatcctgtttctacactaacttgtggtgtgatattgagaaagttccttggcttccctggccagggaggagtcatcactgcccggaaggaattacaaaccccctctgggtgaatggggtcattgagaggttgcaatgggggtggggccaggcagagtggaagtgggaaggcaatggcagagagtccctgggcagatggactagagccaggggcaagttcgatttgggaagtggagaccaccactcagtatttacccacaagtccttcctgggtgtattttgtcacccccatttcccagaggaagcaatcaatggtcagaggagccaggattctggtccaggacatttttctgaagtgccaggtactgcacatgataggcaaaggggttctcgccctggccctgatgctcagaggctgtgtgacttttggctgctcactgcatctctctgagcctcatagtttcacccgtaaaatgagcagaccacccaacagaggtgttttaaaccttagggtttccaatttagtgtgtctttccttatccaagagctgggagaggaaaagggtggagactgggagactgttaaccccaggcttcatagtcagaaaaccctgggcccagatacccactttgttacttcctgactgagcctttcctctcattgaaaactgagccaggctcagtggctcatgcctgtaaatcacagctactcggcctcacatgagaccaggtgtttgagaccaccctggccaacatagcaagactccatctctacacaaaaaaaacaaaaagaaaaaccaccaagaaccaaaacattagctgaacatggtggtgggtgcctgtaatcccagctactcgggaggctgaggtgggaggatcacttgagcttgggaattggaggctgcagtgagccatgactgcaccactccactccaggctggatgacagagtgagaccctgtttcaaaaaacaaaaaaaattaaagagaagaaaaaaacaaacaaacagggatatcccaccttcctcccaaggtggagagcaaagacacagcaagtgtcagcaatgaaagtgatacttaggaaaggtactcaggacaagaggggctcttggggtggggggagcagatgcagagagtgaggaggaccgcaggggagcccgcttcctacacccacccctttgtctgctcccttttattatttctgccccttctctttgtaggcaactggaattattttggctggggtgagcagcacagtaagtactcagcctgattgatgttctgggaggcccatgggaaggtgggcaccttggtgatcccaaggcccctccccactatcacacagggaagcagggagcctgtgaccagcacatgggggccagggggcttggcgagacccctttcaagctttcctgtaccctgttcgttagtgcctgtcttgggaggcccgctgtctgctggggagtgggcaccgtcgttggggtgggggggttcagcctggaggagtggacatttagaccgacaacctgcctgtgtccagctgggtgctgtggcctcctcccgccactccccctgtgtaacctcacctcctctcctgtatcccctgccttttggtcttcctatcttccttctccgcttggaaatgggtccagtgtcactcagagggtagtgggtggccggggtctccaacagaggggtgggccaggaacctcagggagatgcacgcggagacctcaccaaccccctaggctccgcccatactcacaccttacctttcatcttcatttgctgtcccagggaagaaggcaagccacgccctccctaaatttaatgtccatttttctttttctttttctttttctttttttttttattgagatggagtctcactctgtcacccagtctggagggcagtggcacgatctcggctcactgcaagctccgcctcccgggttcacgccattctcctgcctcagcctcccaagtagctgggactacaggcgcccaccacctcgcccggctagtttttttttttttgtattttttagtagagatggggtttccccgggttagccaggatggtctcgatctcctgacctcgtgatctgcccgtctaggcctcccaaagtgctaggattacaggcttgagccaccgctcctggccaatttttttgtatttttaatagagacggggtttcaccatgttggccaggctggttgtgaactcttgacttcaggtgatccacccaccttggcctcccaaagggttgggattacaagtttgagccactgtgcccggcctcctgtgagaatctaatgccaccgctgatctgacaggaggcggaactcaggcggtaatgtgagtgatggggagcaactgtaaatacagatgaggccgggcgcggtggctcaagcctgtaatcccagcactttgggaagccgaggcgggcggatcacaaggtcaggagatcgagaccacagtgaaaccccgtctctactaaaaaaaatacaaaaaaattagccgggcgcggtggcgggcgcctgtagtcccagctactcaggaggctgaggcaggagaatggcctaaacccgggaggcggagcttgcagtgagccgagatcgcgccactgcactccagcctgggcaacagcgtgagactccgtctcaaaaaaaaaaaaaaaaaatacagatgaaacttctctcactcacccaaccgccgcccacctcctgctgtgcggcccagctcctaacaggccacagaccagacccgtgccctaaggagttgctccctttctcccataccctgcctcttctagagagacccagtcctctattctcttttttttttttttttttttttttgagatggagtctcgctctgtcacccagactggagtacagtggtgcgatctctgctcactgcaacctccccctcccgggttcaagcaattctcctgcctcagcctcctgagtagctgggattacaggtgcatgccactatgcctggctaatttttgtatttttagtagagatggggtttcaccatgttggccaggctggtcttgaactcctgacctcaagcaatcctcctgtctcggcctcccaaagtgctgggattacaggtgtgagttaccatgcctggccagtcctctattctgaggataaatctgcctccttctctcttctccaccaactgggaagtccttcactccttccttatatcctggtggacaaacctatctccaggaccagtgaaactgttgacaaacactttggtccaccacaatttatcaaaaacgagttggttaaaaatcaatttagggccgggtacggtggctcacgcctgtaatcccagcactttgggaggccaaggcgggcggatcacgaggtcagatcatgatctgagctgagatcgcaccactgcactccagcctgggcgacagagcgagactccaactcaaaaaaaaaaaaaatcaatttaggccagccacagtggcttacacctacaattccaacactttgggaggctgaggcgggaggattgcttgagccccaaagtttgaaatcagcccgggcaacacagcaagaccccaccgctacaaaaaaaaaaaaaaaaaaggccaggtgtggtggtgtgcccctgtagtcccagctattcaggaggctgaggcgggaggactgcttgagcccaggaggtcaagggtgcaataagccatcattgtgcggctgcacttcagcctaggcaacagtgtgagaccccatttctaaaaaataaatatattaaaataaataaataaatagataaataaaatcaatttcaccaaaatgaatgcttggcagacagggcaagcttgataacaaccaacttgccacaaacgaacagtatggtcaaaagcaaagacaggccaggcacggcagctcacgccataatcccagtactttgggaggccaaggtaggcagattacttgaggtcaggagtttgacaccagcctggccaacaggatgaaacctggtcactactaaaaatacaaaaactagccaggcatggtggtgcatgcctgtaatcccagctactcgggaggctgagtcaggagaatcatttgaacctgggaggtggaggctgcaatgagctgagattgcatcattgtactctagcctgggtgacagagcgagactccttcttaaaaaaaaaaacccggccgggcgcggtggctcaagcctgtaatcccagcactttgggaggccgagacgggtggatcacgaggtcaagagatcgagaccatcctggcaaacacggtgaaaccccgtctctactaaaaaataccaaaacaactagctgggcgaggtggcgggcgcctgtagtcccagctactcgggaggctgaggcaggagaatggcctaaacctggtagacggagcttgcagtgagccgagatctggccactgcactccagcctgggcaacagagcaatactccgtctcaaaaaaaaaacaaaaaaaaacccttggccaggtgcggtggctcacgcctgtaatcccagcactttgggaggccgagacgggcggatcacgaggtcaggagatcgagaccatcctggctaacccggtgaaaccccgtctctactaaaagatacaaaaaactagccaggcgaggtggcgggcgcctgtagtcccagctactcgggaggctgaggcaggagaatggcgggaacccgggaggcggagcttgcagtgagccgagatcgtgccactgcactccagcctgggcgatagagcgagactccgtctcaaaaaaaaaaataaataaataaataacccggctgggagcggtggctcaagcctgtaatcccagcactttgggaggccgaggcgggcagatcacgaggtcaggagatcgagaccatcctggctaacacggtgaaaccatgtctctactaaaaatacaaaaaaattagccaggcatggtggcgggcgcctgtagtcctagctactcgggaggctgaggcaggagaatggcgtgaacccgggaggcggagcttgcagtgagccgaaatcgcaccactgcactccagcctgggcgacagagcgagactccgtctcaaaaaaaaaaaaaaaaaaaaaacccaaaaaccaaacaaacagaacaaaacaccaatgcagctaaagctgatagataattgggtcaaaaaggaaagacaattgagctaaaaacagaccactgggtcaaaacaaaagtggttgaaaatagccagaagcaggcaatttagtcaagagctacttaagaaagcagagcctgggcaaaagcaaaaagaattcaattcaaagtaatttacccttcataagcagataatttgtcagggggaaaaaaaaaaaactgggtgaacatgtgcacagcctcatgcaatttggctggaaacatctcagcccggtcaaggacaattgggtagaaagaatgctggccggccaaggtggctcatgcctgtaatcccagcactttgggaggctgaggcgggaagattgcttgagcccaggagttcaagatcagcctgggcaatatagcaagatcccatctctacaaaataataagtaaataaaattagctgggcgtggtggtgtgtacctgtggtcccaggtactctgtagtctgaggtgggaggatctctcgagcccaggaggtcgaggcttcagtgagctatgaaagtgccactgcactccagcccaagtgagagagactctgtctaaatgaatggatgaatacagcaaaagtctgaaggtttcactcattgctctgagactttggggtctgggcgtttcttcatttttttacatcctcttcccctaccccatacttctcatgttttcttcatggactactttttttttttttttttttttttttttttttttttgatacagggtctcattctgtcgcccagactgcagtgcagtggcgtaatcatagttcactgctacctcgatctcctgggctcaagcaatgctcctgctgtagcctcccaaatagctgggactacaagcgcccaccaccacacccagctaatttttaaattttttaaagagatggggtcttactccatcctggctaacacagtgaaaccccgtctctactaaaaatacaaaaaattagccggacgtggtggcaggcgcctgtagtcccagctattctggaggctgaggcaggagagcttgcagtgagcggagcttgtgccactgcactccagcctgggcaacagagtgagactctgtctcaaaaaaaaaaaaaaaaaaaaaaaaaagatggagtcttgctgttgcccaggctgatcttgaactcctgggctcaagtgatcctcctgccttggcctcccaaagtgctgagatt

SEQ ID NO: 320 - DNA, 21 bp, synthetic construct
  source 1..21: mol_type = other DNA
ccccgtaccatgtccagtaca

SEQ ID NO: 321 - DNA, 25 bp, synthetic construct
  source 1..25: mol_type = other DNA
cattcaccagcatttattcaacaaa

SEQ ID NO: 322 - DNA, 21 bp, synthetic construct
  source 1..21: mol_type = other DNA
ctcactaaagggaacaagcga

SEQ ID NO: 323 - DNA, 19 bp, synthetic construct
  source 1..19: mol_type = other DNA
gtggaacaggttctcatgc

SEQ ID NO: 324 - DNA, 15 bp, synthetic construct
  source 1..15: mol_type = other DNA
gatcaaaggcgagga

SEQ ID NO: 325 - RNA, 1288 nt, synthetic construct
  source 1..1288: mol_type = other RNA
gtgagggtcattgctcggcccctcccatgccacttccactcaccattcctgcctgcccagctcttcctctttctggccacaccatccacactctcctggccctctgagactgcccgccatgccattccctttacctggaaaactcctccctatccatcaaagtccagattcagggtcacctcctctgggaagcccaccttggcctccaggttgactctcactactcatcatcaggttcttccttctattccagccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgggtgagtacatggatggatagatggatgagttggtgggtagattcgtggctagatggatgatggatggatggacagatggatggatatatgattgaactattgaaagtatagatgtatggatgggtgaatttgggggtaattgttagatgatggatgagtatagatgaatgatggatggataacttgatgagtggatagatagattgctggatagatgattgactgggtggatagatgaaatgttggatgagcagattaagttgtattggatgggatggatggaagtgtggttgagttattagaaggaagattgagtagataggtgaatttgttgatagtcagatgggtagataggtagatggatggatggatggatggatgtataggcagatggacaaatggatgaatgggtgggtggatgaatggaaggatgtgtggttgaactattgcaagtattgataattgggttcataatttctgaatatttagatggatggttgtgagtggctggtggacagacgaaaaatggatggttggataaattgatgggtggatggatggttggttgtatgaaagaatgaatgattgggtaggtggattaagttgcggatcaatgtatgggatggatgaatggatggatggatggatgtgtggttgaattactgaaaggttggaagagtggatgggtgaaatttggggtagttagatgggtgggtgtgtggatggataaaagagtagatgaatgaattaatgaataaacaggcagatggatgatgtaagctgccccagaccctgggacctctgacccccggcgaccccttgcactctccatgacactttctctcccatggtggcag

SEQ ID NO: 326 - RNA, 128 nt, Homo sapiens
  source 1..128: mol_type = genomic RNA
ctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 327 - DNA, 92 bp, synthetic construct
  source 1..92: mol_type = other DNA
ctgggtatgtctcttccagctgcctgggtttcctggaaagaactcttatccccaggaactagtttgttgaataaatgctggtgaatgaatga

SEQ ID NO: 328 - DNA, 26 bp, synthetic construct
  source 1..26: mol_type = other DNA
cgaatctacccacatctgttcaatca

SEQ ID NO: 329 - skipped

SEQ ID NO: 330 - DNA, 91 bp, Macaca fascicularis
  source 1..91: mol_type = genomic DNA
ctgggtatgtctcctccagctgcctggggttcctggaaagaactgtatccccaggaactagtttgttgaatgaatgctggtgaatgaatga

SEQ ID NO: 331 - DNA, 13 bp, Macaca fascicularis
  source 1..13: mol_type = genomic DNA
tgatgggtgggtg

SEQ ID NO: 332 - DNA, 13 bp, Homo sapiens
  source 1..13: mol_type = genomic DNA
gatatatgattga

SEQ ID NO: 333 - DNA, 13 bp, Macaca fascicularis
  source 1..13: mol_type = genomic DNA
gatatgtgactga

SEQ ID NO: 334 - DNA, 178 bp, synthetic construct
  source 1..178: mol_type = other DNA
ccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 335 - RNA, 178 nt, synthetic construct
  source 1..178: mol_type = other RNA
ccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 336 - DNA, 431 bp, synthetic construct
  source 1..431: mol_type = other DNA
gtgagggtcattgctcggcccctcccatgccacttccactcaccattcctgcctgcccagctcttcctctttctggccacaccatccacactctcctggccctctgagactgcccgccatgccattccctttacctggaaaactcctccctatccatcaaagtccagattcagggtcacctcctctgggaagcccaccttggcctccaggttgactctcactactcatcatcaggttcttccttctattccagccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 337 - RNA, 431 nt, synthetic construct
  source 1..431: mol_type = other RNA
gtgagggtcattgctcggcccctcccatgccacttccactcaccattcctgcctgcccagctcttcctctttctggccacaccatccacactctcctggccctctgagactgcccgccatgccattccctttacctggaaaactcctccctatccatcaaagtccagattcagggtcacctcctctgggaagcccaccttggcctccaggttgactctcactactcatcatcaggttcttccttctattccagccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgg

SEQ ID NO: 338 - DNA, 24 bp, synthetic construct
  source 1..24: mol_type = other DNA
catttattcaacggataagagttc

SEQ ID NO: 339 - DNA, 25 bp, synthetic construct
  source 1..25: mol_type = other DNA
catttattcaacggggataagagtt

SEQ ID NO: 340 - DNA, 25 bp, synthetic construct
  source 1..25: mol_type = other DNA
gcatttattcaaggggataagagtt

SEQ ID NO: 341 - DNA, 25 bp, synthetic construct
  source 1..25: mol_type = other DNA
gcatttattcaacgggataagagtt

SEQ ID NO: 342 - DNA, 25 bp, synthetic construct
  source 1..25: mol_type = other DNA
gcatttattcaacggggataagagt

SEQ ID NO: 343 - DNA, 25 bp, synthetic construct
  source 1..25: mol_type = other DNA
tgttcaatcattgggataagagttc

SEQ ID NO: 344 - DNA, 25 bp, synthetic construct
  source 1..25: mol_type = other DNA
tgttcaatcattcgggataagagtt

SEQ ID NO: 345 - DNA, 26 bp, synthetic construct
  source 1..26: mol_type = other DNA
tgttcaatcattcgggataagagttc

SEQ ID NO: 346 - skipped

SEQ ID NO: 347 - DNA, 26 bp, synthetic construct
  source 1..26: mol_type = other DNA
tctgttcaatcattggggataagagt

SEQ ID NO: 348 - DNA, 26 bp, synthetic construct
  source 1..26: mol_type = other DNA
tctgttcaatcatggggataagagtt

SEQ ID NO: 349 - DNA, 26 bp, synthetic construct
  source 1..26: mol_type = other DNA
tctgttcaatcatgggataagagttc

SEQ ID NO: 350 - DNA, 26 bp, synthetic construct
  source 1..26: mol_type = other DNA
ctgttcaatcatttggggataagagt

SEQ ID NO: 351 - DNA, 26 bp, synthetic construct
  source 1..26: mol_type = other DNA
ctgttcaatcattggggataagagtt

SEQ ID NO: 352 - DNA, 26 bp, synthetic construct
  source 1..26: mol_type = other DNA
ctgttcaatcattgggataagagttc

SEQ ID NO: 353 - DNA, 26 bp, synthetic construct
  source 1..26: mol_type = other DNA
tgttcaatcattctggggataagagt

SEQ ID NO: 354 - DNA, 26 bp, synthetic construct
  source 1..26: mol_type = other DNA
tgttcaatcattcggataagagttct

SEQ ID NO: 355 - DNA, 26 bp, synthetic construct
  source 1..26: mol_type = other DNA
tccatccatccttgagttctttccag

SEQ ID NO: 356 - skipped

SEQ ID NO: 357 - DNA, 26 bp, synthetic construct
  source 1..26: mol_type = other DNA
ctctccatccatcttctttccaggaa

SEQ ID NO: 358 - DNA, 24 bp, synthetic construct
  source 1..24: mol_type = other DNA
atccatctatccggataagagttc

SEQ ID NO: 359 - DNA, 24 bp, synthetic construct
  source 1..24: mol_type = other DNA
atccatctatccgggataagagtt

SEQ ID NO: 360 - DNA, 26 bp, synthetic construct
  source 1..26: mol_type = other DNA
caactcatccatcagagttctttcca

SEQ ID NO: 361 - DNA, 26 bp, synthetic construct
  source 1..26: mol_type = other DNA
gccacgaatctacggataagagttct

SEQ ID NO: 362 - DNA, 24 bp, synthetic construct
  source 1..24: mol_type = other DNA
cacgaatctaccgataagagttct

SEQ ID NO: 363 - DNA, 24 bp, synthetic construct
  source 1..24: mol_type = other DNA
ccacgaatctacgataagagttct

SEQ ID NO: 364 - DNA, 24 bp, synthetic construct
  source 1..24: mol_type = other DNA
cacgaatctaccggggataagagt

SEQ ID NO: 365 - DNA, 24 bp, synthetic construct
  source 1..24: mol_type = other DNA
ccacgaatctacggggataagagt

SEQ ID NO: 366 - DNA, 24 bp, synthetic construct
  source 1..24: mol_type = other DNA
cacgaatctaccggataagagttc

SEQ ID NO: 367 - DNA, 24 bp, synthetic construct
  source 1..24: mol_type = other DNA
cacgaatctaccgggataagagtt

SEQ ID NO: 368 - DNA, 24 bp, synthetic construct
  source 1..24: mol_type = other DNA
ccacgaatctacggataagagttc

SEQ ID NO: 369 - DNA, 24 bp, synthetic construct
  source 1..24: mol_type = other DNA
ccacgaatctacgggataagagtt

SEQ ID NO: 370 - DNA, 26 bp, synthetic construct
  source 1..26: mol_type = other DNA
acgaatctacccaggggataagagtt

SEQ ID NO: 371 - DNA, 26 bp, synthetic construct
  source 1..26: mol_type = other DNA
ctagccacgaatctaagagttctttc

SEQ ID NO: 372 - DNA, 26 bp, synthetic construct
  source 1..26: mol_type = other DNA
ccacgaatctaccataagagttcttt

SEQ ID NO: 373 - DNA, 26 bp, synthetic construct
  source 1..26: mol_type = other DNA
ccatccatcatccgggataagagtcc

SEQ ID NO: 374 - DNA, 24 bp, synthetic construct
  source 1..24: mol_type = other DNA
ccatccatcatcggggataagagt

SEQ ID NO: 375 - DNA, 26 bp, synthetic construct
  source 1..26: mol_type = other DNA
tcatccatctagcgggataagagttc

SEQ ID NO: 376 - DNA, 26 bp, synthetic construct
  source 1..26: mol_type = other DNA
catccatctagccgggataagagttc

SEQ ID NO: 377 - DNA, 26 bp, synthetic construct
  source 1..26: mol_type = other DNA
tccatctagccacggggataagagtt

SEQ ID NO: 378 - DNA, 24 bp, synthetic construct
  source 1..24: mol_type = other DNA
atccatctagccgggataagagtt

SEQ ID NO: 379 - DNA, 24 bp, synthetic construct
  source 1..24: mol_type = other DNA
atccatctagccggggataagagt

SEQ ID NO: 380 - DNA, 26 bp, synthetic construct
  source 1..26: mol_type = other DNA
ccatccatcatccggggataagagtt

SEQ ID NO: 381 - DNA, 26 bp, synthetic construct
  source 1..26: mol_type = other DNA
atatatccatccactagttcctgggg

SEQ ID NO: 382 - skipped

SEQ ID NO: 383 - DNA, 26 bp, synthetic construct
  source 1..26: mol_type = other DNA
tagttcaatcataagagttctttcca

SEQ ID NO: 384 - DNA, 20 bp, synthetic construct
  source 1..20: mol_type = other DNA
tcatctgttcaacaaactag

SEQ ID NO: 385 - DNA, 26 bp, synthetic construct
  source 1..26: mol_type = other DNA
atctgttcaatcagcatttattcaac

SEQ ID NO: 386 - DNA, 20 bp, synthetic construct
  source 1..20: mol_type = other DNA
atctacccaccagcatttat

SEQ ID NO: 387 - DNA, 26 bp, synthetic construct
  source 1..26: mol_type = other DNA
ccacgaatctaccgttcaatcattca

SEQ ID NO: 388 - DNA, 26 bp, synthetic construct
  source 1..26: mol_type = other DNA
cacgaatctacccattcaccagcatt

SEQ ID NO: 389 - DNA, 26 bp, synthetic construct
  source 1..26: mol_type = other DNA
acgaatctacccagttcaatcattca

SEQ ID NO: 390 - DNA, 20 bp, synthetic construct
  source 1..20: mol_type = other DNA
ccatccatgtactcaatcat

SEQ ID NO: 391 - DNA, 24 bp, synthetic construct
  source 1..24: mol_type = other DNA
cgaatctacccacctgttcaatca

SEQ ID NO: 392 - DNA, 24 bp, synthetic construct
  source 1..24: mol_type = other DNA
cgaatctacccactctgttcaatc

SEQ ID NO: 393 - DNA, 25 bp, synthetic construct
  source 1..25: mol_type = other DNA
cgaatctacccaatctgttcaatca

SEQ ID NO: 394 - DNA, 25 bp, synthetic construct
  source 1..25: mol_type = other DNA
cgaatctacccactctgttcaatca

SEQ ID NO: 395 - DNA, 25 bp, synthetic construct
  source 1..25: mol_type = other DNA
acgaatctaccccatctgttcaatc

SEQ ID NO: 396 - DNA, 25 bp, synthetic construct
  source 1..25: mol_type = other DNA
acgaatctacccaatctgttcaatc

SEQ ID NO: 397 - DNA, 26 bp, synthetic construct
  source 1..26: mol_type = other DNA
cacgaatctaccctgttcaatcattc

SEQ ID NO: 398 - DNA, 26 bp, synthetic construct
  source 1..26: mol_type = other DNA
acgaatctacccatgttcaatcattc

SEQ ID NO: 399 - DNA, 26 bp, synthetic construct
  source 1..26: mol_type = other DNA
ccacgaatctaccctgttcaatcatt

SEQ ID NO: 400 - DNA, 26 bp, synthetic construct
  source 1..26: mol_type = other DNA
acgaatctacccactgttcaatcatt

SEQ ID NO: 401 - DNA, 26 bp, synthetic construct
  source 1..26: mol_type = other DNA
ccacgaatctacccatctgttcaatc

SEQ ID NO: 402 - DNA, 20 bp, synthetic construct
  source 1..20: mol_type = other DNA
agccacgaatctgttcaatc

SEQ ID NO: 403 - DNA, 20 bp, synthetic construct
  source 1..20: mol_type = other DNA
ccaccaactcattcatctgt

SEQ ID NO: 404 - DNA, 26 bp, synthetic construct
  source 1..26: mol_type = other DNA
cgaatctacccacatctgttcaatca

SEQ ID NO: 405 - DNA, 20 bp, synthetic construct
  source 1..20: mol_type = other DNA
ccatccatcatctgttcaat

SEQ ID NO: 406 - DNA, 20 bp, synthetic construct
  source 1..20: mol_type = other DNA
ccatccatgtactgttcaat

SEQ ID NO: 407 - DNA, 20 bp, synthetic construct
  source 1..20: mol_type = other DNA
ccatccatgtactttcaatc

SEQ ID NO: 408 - DNA, 20 bp, synthetic construct
  source 1..20: mol_type = other DNA
ccatccatgtacttcaatca

SEQ ID NO: 409 - DNA, 26 bp, synthetic construct
  source 1..26: mol_type = other DNA
acgaatctacccaatccttttatcta

SEQ ID NO: 410 - DNA, 26 bp, synthetic construct
  source 1..26: mol_type = other DNA
cgaatctacccacatccttttatcta

SEQ ID NO: 411 - DNA, 26 bp, synthetic construct
  source 1..26: mol_type = other DNA
cacgaatctaccccttttatctactc

SEQ ID NO: 412 - DNA, 26 bp, synthetic construct
  source 1..26: mol_type = other DNA
acgaatctacccatccttttatctac

SEQ ID NO: 413 - DNA, 26 bp, synthetic construct
  source 1..26: mol_type = other DNA
acgaatctacccacttttatctactc

SEQ ID NO: 414 - DNA, 26 bp, synthetic construct
  source 1..26: mol_type = other DNA
cacgaatctacccatccttttatcta

SEQ ID NO: 415 - DNA, 20 bp, synthetic construct
  source 1..20: mol_type = other DNA
ccatccatgtactttttatc

SEQ ID NO: 416 - DNA, 20 bp, synthetic construct
  source 1..20: mol_type = other DNA
ccatccatgtactcttttat

SEQ ID NO: 417 - DNA, 20 bp, synthetic construct
  source 1..20: mol_type = other DNA
ccatccatgtacttgtactc

SEQ ID NO: 418 - DNA, 26 bp, synthetic construct
  source 1..26: mol_type = other DNA
cgaatctacccaccatccatgtactc

SEQ ID NO: 419 - DNA, 26 bp, synthetic construct
  source 1..26: mol_type = other DNA
cgaatctacccacatccatgtactca

SEQ ID NO: 420 - DNA, 26 bp, synthetic construct
  source 1..26: mol_type = other DNA
gccacgaatctactccatgtactcac

SEQ ID NO: 421 - DNA, 26 bp, synthetic construct
  source 1..26: mol_type = other DNA
acgaatctacccacatccatgtactc

SEQ ID NO: 422 - DNA, 26 bp, synthetic construct
  source 1..26: mol_type = other DNA
acgaatctacccaatccatgtactca

SEQ ID NO: 423 - DNA, 26 bp, synthetic construct
  source 1..26: mol_type = other DNA
cgaatctacccactccatgtactcac

SEQ ID NO: 424 - DNA, 24 bp, synthetic construct
  source 1..24: mol_type = other DNA
acgaatctacccatccatgtactc

SEQ ID NO: 425 - DNA, 20 bp, synthetic construct
  source 1..20: mol_type = other DNA
acgaatccatccatgtactc

SEQ ID NO: 426 - DNA, 20 bp, synthetic construct
  source 1..20: mol_type = other DNA
acgaatcatccatgtactca

SEQ ID NO: 427 - DNA, 20 bp, synthetic construct
  source 1..20: mol_type = other DNA
cgaatctcatccatgtactc

SEQ ID NO: 428 - DNA, 20 bp, synthetic construct
  source 1..20: mol_type = other DNA
cgaatctatccatgtactca

SEQ ID NO: 429 - DNA, 20 bp, synthetic construct
  source 1..20: mol_type = other DNA
gaatctacatccatgtactc

SEQ ID NO: 430 - DNA, 20 bp, synthetic construct
  source 1..20: mol_type = other DNA
aatctaccatccatgtactc

SEQ ID NO: 431 - DNA, 20 bp, synthetic construct
  source 1..20: mol_type = other DNA
gaatctacccatctctccat

SEQ ID NO: 432 - DNA, 20 bp, synthetic construct
  source 1..20: mol_type = other DNA
tccatcatccatgtactcac

SEQ ID NO: 433 - DNA, 20 bp, synthetic construct
  source 1..20: mol_type = other DNA
gaatctacccatccatgtac

SEQ ID NO: 434 - DNA, 20 bp, synthetic construct
  source 1..20: mol_type = other DNA
ccatccatgtacttcaccca

SEQ ID NO: 435 - DNA, 20 bp, synthetic construct
  source 1..20: mol_type = other DNA
caatcatccatccatgtact

SEQ ID NO: 436 - DNA, 20 bp, synthetic construct
  source 1..20: mol_type = other DNA
gttcaatccatccatgtact

SEQ ID NO: 437 - DNA, 20 bp, synthetic construct
  source 1..20: mol_type = other DNA
ttcaatcccatccatgtact

SEQ ID NO: 438 - DNA, 20 bp, synthetic construct
  source 1..20: mol_type = other DNA
tcaatcaccatccatgtact

SEQ ID NO: 439 - DNA, 20 bp, synthetic construct
  source 1..20: mol_type = other DNA
ttttatcccatccatgtact

SEQ ID NO: 440 - DNA, 20 bp, synthetic construct
  source 1..20: mol_type = other DNA
cttttatccatccatgtact

SEQ ID NO: 441 - DNA, 20 bp, synthetic construct
  source 1..20: mol_type = other DNA
tcacccaccatccatgtact

SEQ ID NO: 442 - DNA, 26 bp, synthetic construct
  source 1..26: mol_type = other DNA
ccatccatgtactccatccatgtact

SEQ ID NO: 443-444 - skipped (2 entries)

SEQ ID NO: 445 - DNA, 26 bp, synthetic construct
  source 1..26: mol_type = other DNA
gccacgaatctactccatccatgtac

SEQ ID NO: 446 - DNA, 26 bp, synthetic construct
  source 1..26: mol_type = other DNA
gccacgaatctacccatccatgtact

SEQ ID NO: 447 - DNA, 26 bp, synthetic construct
  source 1..26: mol_type = other DNA
cacgaatctaccctccatccatgtac

SEQ ID NO: 448 - DNA, 26 bp, synthetic construct
  source 1..26: mol_type = other DNA
acgaatctacccaccatccatgtact

SEQ ID NO: 449 - DNA, 26 bp, synthetic construct
  source 1..26: mol_type = other DNA
ccacgaatctaccccatccatgtact

SEQ ID NO: 450 - DNA, 22 bp, synthetic construct
  source 1..22: mol_type = other DNA
acgaatctatccatccatgtac

SEQ ID NO: 451 - DNA, 26 bp, synthetic construct
  source 1..26: mol_type = other DNA
cgaatctacccacccatccatgtact

SEQ ID NO: 452 - DNA, 20 bp, synthetic construct
  source 1..20: mol_type = other DNA
acgaatcccatccatgtact

SEQ ID NO: 453 - DNA, 20 bp, synthetic construct
  source 1..20: mol_type = other DNA
gccacgaccatccatgtact

SEQ ID NO: 454 - DNA, 20 bp, synthetic construct
  source 1..20: mol_type = other DNA
cgaatctccatccatgtact

SEQ ID NO: 455 - DNA, 20 bp, synthetic construct
  source 1..20: mol_type = other DNA
gaatctaccatccatgtact

SEQ ID NO: 456 - DNA, 20 bp, synthetic construct
  source 1..20: mol_type = other DNA
aatctacccatccatgtact

SEQ ID NO: 457 - DNA, 20 bp, synthetic construct
  source 1..20: mol_type = other DNA
acgaatctccatccatgtac

SEQ ID NO: 458 - DNA, 20 bp, synthetic construct
  source 1..20: mol_type = other DNA
cgaatcttccatccatgtac

SEQ ID NO: 459 - DNA, 20 bp, synthetic construct
  source 1..20: mol_type = other DNA
gaatctatccatccatgtac

SEQ ID NO: 460 - DNA, 19 bp, synthetic construct
  source 1..19: mol_type = other DNA
gaatctaccatccatgtac

SEQ ID NO: 461 - DNA, 21 bp, synthetic construct
  source 1..21: mol_type = other DNA
gaatctacccatccatgtact

SEQ ID NO: 462 - DNA, 21 bp, synthetic construct
  source 1..21: mol_type = other DNA
cgaatctaccatccatgtact

SEQ ID NO: 463 - DNA, 22 bp, synthetic construct
  source 1..22: mol_type = other DNA
acgaatctaccatccatgtact

SEQ ID NO: 464 - DNA, 23 bp, synthetic construct
  source 1..23: mol_type = other DNA
cacgaatctaccatccatgtact

SEQ ID NO: 465 - DNA, 24 bp, synthetic construct
  source 1..24: mol_type = other DNA
ccacgaatctaccatccatgtact

SEQ ID NO: 466 - DNA, 20 bp, synthetic construct
  source 1..20: mol_type = other DNA
gaatctaccatccatgtact

SEQ ID NO: 467 - DNA, 21 bp, synthetic construct
  source 1..21: mol_type = other DNA
gaatctacccatccatgtact

SEQ ID NO: 468 - DNA, 22 bp, synthetic construct
  source 1..22: mol_type = other DNA
cgaatctacccatccatgtact

SEQ ID NO: 469 - DNA, 22 bp, synthetic construct
  source 1..22: mol_type = other DNA
gaatctaccccatccatgtact

SEQ ID NO: 470 - DNA, 23 bp, synthetic construct
  source 1..23: mol_type = other DNA
acgaatctacccatccatgtact

SEQ ID NO: 471 - DNA, 23 bp, synthetic construct
  source 1..23: mol_type = other DNA
cgaatctaccccatccatgtact

SEQ ID NO: 472 - DNA, 23 bp, synthetic construct
  source 1..23: mol_type = other DNA
gaatctacccccatccatgtact

SEQ ID NO: 473 - DNA, 24 bp, synthetic construct
  source 1..24: mol_type = other DNA
cgaatctacccccatccatgtact

SEQ ID NO: 474 - DNA, 24 bp, synthetic construct
  source 1..24: mol_type = other DNA
gaatctacccaccatccatgtact

SEQ ID NO: 475 - DNA, 20 bp, synthetic construct
  source 1..20: mol_type = other DNA
cgaatctacatccatgtact

SEQ ID NO: 476 - DNA, 20 bp, synthetic construct
  source 1..20: mol_type = other DNA
acgaatctacatccatgtac

SEQ ID NO: 477 - DNA, 20 bp, synthetic construct
  source 1..20: mol_type = other DNA
gaatctaccccatccatgta

SEQ ID NO: 478 - DNA, 20 bp, synthetic construct
  source 1..20: mol_type = other DNA
cacgaatctatccatgtact

SEQ ID NO: 479 - DNA, 20 bp, synthetic construct
  source 1..20: mol_type = other DNA
cacgaatctaatccatgtac

SEQ ID NO: 480 - DNA, 20 bp, synthetic construct
  source 1..20: mol_type = other DNA
cacgaatctacatccatgta

SEQ ID NO: 481 - DNA, 20 bp, synthetic construct
  source 1..20: mol_type = other DNA
gaatctacccccatccatgt

SEQ ID NO: 482 - DNA, 21 bp, synthetic construct
  source 1..21: mol_type = other DNA
gaatctacacatccatgtact

SEQ ID NO: 483-488 - skipped (6 entries)

SEQ ID NO: 489 - DNA, 20 bp, synthetic construct
  source 1..20: mol_type = other DNA
tctacccccatccatgtact

SEQ ID NO: 490 - DNA, 20 bp, synthetic construct
  source 1..20: mol_type = other DNA
atctaccccatccatgtact

SEQ ID NO: 491 - DNA, 20 bp, synthetic construct
  source 1..20: mol_type = other DNA
gtcgccgccatccatgtact

SEQ ID NO: 492 - DNA, 20 bp, synthetic construct
  source 1..20: mol_type = other DNA
ggggtcgccatccatgtact

SEQ ID NO: 493 - DNA, 20 bp, synthetic construct
  source 1..20: mol_type = other DNA
gggtcgcccatccatgtact

SEQ ID NO: 494 - DNA, 20 bp, synthetic construct
  source 1..20: mol_type = other DNA
ggtcgccccatccatgtact

SEQ ID NO: 495 - DNA, 12 bp, synthetic construct
  source 1..12: mol_type = other DNA
gcatttattcaa

SEQ ID NO: 496 - DNA, 12 bp, synthetic construct
  source 1..12: mol_type = other DNA
tgttcaatcatt

SEQ ID NO: 497 - DNA, 13 bp, synthetic construct
  source 1..13: mol_type = other DNA
tccatccatcctt

SEQ ID NO: 498 - DNA, 13 bp, synthetic construct
  source 1..13: mol_type = other DNA
ctctccatccatc

SEQ ID NO: 499 - DNA, 12 bp, synthetic construct
  source 1..12: mol_type = other DNA
atccatctatcc

SEQ ID NO: 500 - DNA, 13 bp, synthetic construct
  source 1..13: mol_type = other DNA
caactcatccatc

SEQ ID NO: 501 - DNA, 12 bp, synthetic construct
  source 1..12: mol_type = other DNA
ccacgaatctac

SEQ ID NO: 502 - DNA, 12 bp, synthetic construct
  source 1..12: mol_type = other DNA
gccacgaatcta

SEQ ID NO: 503 - DNA, 13 bp, synthetic construct
  source 1..13: mol_type = other DNA
tcatccatctagc

SEQ ID NO: 504 - DNA, 13 bp, synthetic construct
  source 1..13: mol_type = other DNA
tccatctagccac

SEQ ID NO: 505 - DNA, 12 bp, synthetic construct
  source 1..12: mol_type = other DNA
atccatctagcc

SEQ ID NO: 506 - DNA, 13 bp, synthetic construct
  source 1..13: mol_type = other DNA
atatatccatcca

SEQ ID NO: 507 - DNA, 13 bp, synthetic construct
  source 1..13: mol_type = other DNA
tagttcaatcata

SEQ ID NO: 508 - DNA, 10 bp, synthetic construct
  source 1..10: mol_type = other DNA
tcatctgttc

SEQ ID NO: 509 - DNA, 10 bp, synthetic construct
  source 1..10: mol_type = other DNA
atctacccac

SEQ ID NO: 510 - DNA, 10 bp, synthetic construct
  source 1..10: mol_type = other DNA
ccaccaactc

SEQ ID NO: 511 - DNA, 10 bp, synthetic construct
  source 1..10: mol_type = other DNA
ccatccatca

SEQ ID NO: 512 - DNA, 10 bp, synthetic construct
  source 1..10: mol_type = other DNA
tccatcatcc

SEQ ID NO: 513 - DNA, 10 bp, synthetic construct
  source 1..10: mol_type = other DNA
gaatctaccc

SEQ ID NO: 514 - DNA, 11 bp, synthetic construct
  source 1..11: mol_type = other DNA
ccacgaatcta

SEQ ID NO: 515 - DNA, 11 bp, synthetic construct
  source 1..11: mol_type = other DNA
cacgaatctac

SEQ ID NO: 516 - DNA, 13 bp, synthetic construct
  source 1..13: mol_type = other DNA
ttctttccaggaa

SEQ ID NO: 517 - DNA, 13 bp, synthetic construct
  source 1..13: mol_type = other DNA
agagttctttcca

SEQ ID NO: 518 - DNA, 12 bp, synthetic construct
  source 1..12: mol_type = other DNA
gataagagttct

SEQ ID NO: 519 - DNA, 13 bp, synthetic construct
  source 1..13: mol_type = other DNA
ataagagttcttt

SEQ ID NO: 520 - DNA, 10 bp, synthetic construct
  source 1..10: mol_type = other DNA
aacaaactag

SEQ ID NO: 521 - DNA, 10 bp, synthetic construct
  source 1..10: mol_type = other DNA
cagcatttat

SEQ ID NO: 522 - DNA, 10 bp, synthetic construct
  source 1..10: mol_type = other DNA
attcatctgt

SEQ ID NO: 523 - DNA, 10 bp, synthetic construct
  source 1..10: mol_type = other DNA
tctgttcaat

SEQ ID NO: 524 - DNA, 13 bp, synthetic construct
  source 1..13: mol_type = other DNA
atccttttatcta

SEQ ID NO: 525 - DNA, 13 bp, synthetic construct
  source 1..13: mol_type = other DNA
atccatgtactca

SEQ ID NO: 526 - DNA, 13 bp, synthetic construct
  source 1..13: mol_type = other DNA
tccatgtactcac

SEQ ID NO: 527 - DNA, 12 bp, synthetic construct
  source 1..12: mol_type = other DNA
atccatgtactc

SEQ ID NO: 528 - DNA, 13 bp, synthetic construct
  source 1..13: mol_type = other DNA
cccatctctccat

SEQ ID NO: 529 - DNA, 10 bp, synthetic construct
  source 1..10: mol_type = other DNA
atgtactcac

SEQ ID NO: 530 - DNA, 13 bp, synthetic construct
  source 1..13: mol_type = other DNA
tccatccatgtac

SEQ ID NO: 531 - DNA, 11 bp, synthetic construct
  source 1..11: mol_type = other DNA
catccatgtac

SEQ ID NO: 532 - DNA, 11 bp, synthetic construct
  source 1..11: mol_type = other DNA
ccatccatgta

SEQ ID NO: 533 - DNA, 10 bp, synthetic construct
  source 1..10: mol_type = other DNA
tccatgtact

SEQ ID NO: 534 - DNA, 14 bp, synthetic construct
  source 1..14: mol_type = other DNA
cccatccatgtact

SEQ ID NO: 535 - DNA, 11 bp, synthetic construct
  source 1..11: mol_type = other DNA
atccatgtact

SEQ ID NO: 536 - DNA, 20 bp, synthetic construct
  source 1..20: mol_type = other DNA
ggtctgcacaggaggaaacc

SEQ ID NO: 537 - DNA, 20 bp, synthetic construct
  source 1..20: mol_type = other DNA
ccacacgacccctccagcag

SEQ ID NO: 538 - DNA, 23 bp, synthetic construct
  source 1..23: mol_type = other DNA
ctacgagcatgtcatgaagttgc

SEQ ID NO: 539 - DNA, 23 bp, synthetic construct
  source 1..23: mol_type = other DNA
aagcccattcattcctagtgctg

SEQ ID NO: 540 - DNA, 23 bp, synthetic construct
  source 1..23: mol_type = other DNA
acatccctcagagtgttgtgtca

SEQ ID NO: 541 - DNA, 23 bp, synthetic construct
  source 1..23: mol_type = other DNA
cctggggaggagaatgaggtaaa

SEQ ID NO: 542 - DNA, 23 bp, synthetic construct
  source 1..23: mol_type = other DNA
tccattgaagtgcatgtgtgtag

SEQ ID NO: 543 - DNA, 23 bp, synthetic construct
  source 1..23: mol_type = other DNA
gggaccataagagctaaagttgg

SEQ ID NO: 544 - DNA, 25 bp, synthetic construct
  source 1..25: mol_type = other DNA
gcatttgaaaggtctcaactgtatt

SEQ ID NO: 545 - DNA, 23 bp, synthetic construct
  source 1..23: mol_type = other DNA
ttgttgctgatgaatcttgtgtg

SEQ ID NO: 546 - DNA, 23 bp, synthetic construct
  source 1..23: mol_type = other DNA
gggaatttatctgaagaccaagc

SEQ ID NO: 547 - DNA, 23 bp, synthetic construct
  source 1..23: mol_type = other DNA
tcagcttttgaatggagaatgaa

SEQ ID NO: 548 - DNA, 23 bp, synthetic construct
  source 1..23: mol_type = other DNA
tactctcgctgtctccttgtgtc

SEQ ID NO: 549 - DNA, 23 bp, synthetic construct
  source 1..23: mol_type = other DNA
actgaaagaggctcaggaacact

SEQ ID NO: 550 - DNA, 23 bp, synthetic construct
  source 1..23: mol_type = other DNA
gacagtgactaccgcagtgaaac

SEQ ID NO: 551 - DNA, 23 bp, synthetic construct
  source 1..23: mol_type = other DNA
ccacaagaaaatgtgaattctgc

SEQ ID NO: 552 - DNA, 23 bp, synthetic construct
  source 1..23: mol_type = other DNA
agtgggcttaatttgcattcatt

SEQ ID NO: 553 - DNA, 23 bp, synthetic construct
  source 1..23: mol_type = other DNA
gcacaggtataatcagacccaca

SEQ ID NO: 554 - DNA, 22 bp, synthetic construct
  source 1..22: mol_type = other DNA
ggttggaagaagcactgagagg

SEQ ID NO: 555 - DNA, 23 bp, synthetic construct
  source 1..23: mol_type = other DNA
agaagaaggggaaagtcagaggt

SEQ ID NO: 556 - DNA, 23 bp, synthetic construct
  source 1..23: mol_type = other DNA
agttacaccgtcgtccctatcat

SEQ ID NO: 557 - DNA, 23 bp, synthetic construct
  source 1..23: mol_type = other DNA
atgaccttgaagaagtggctttc

SEQ ID NO: 558 - DNA, 23 bp, synthetic construct
  source 1..23: mol_type = other DNA
cctcacagttgtagaccatggaa

SEQ ID NO: 559 - DNA, 23 bp, synthetic construct
  source 1..23: mol_type = other DNA
cacacctccttccagatgttgta

SEQ ID NO: 560 - DNA, 22 bp, synthetic construct
  source 1..22: mol_type = other DNA
ccctgtctcgtgctccctcaga

SEQ ID NO: 561 - DNA, 22 bp, synthetic construct
  source 1..22: mol_type = other DNA
catgggcaagcagtgtgttcta

SEQ ID NO: 562 - DNA, 23 bp, synthetic construct
  source 1..23: mol_type = other DNA
agagagctcaccattcaccatct

SEQ ID NO: 563 - DNA, 23 bp, synthetic construct
  source 1..23: mol_type = other DNA
tcctaggctctcaaaacaaaacc

SEQ ID NO: 564 - DNA, 388 bp, synthetic construct
  source 1..388: mol_type = other DNA
agcccagggtatccccatggcccgtccacaccagcctggctatgctaactcccaaaccatgcaccaagtctggccccacacatccccagcccagcctccttcccaatgtcagcctggggtttctagatctagagggaggagagaaaactagggctgaaactgggctgaagtcatggttagggatcaaggtcagggttagttcagccatcaaagatcagaggtcagggttagaattggtgttaggcaaaggggtcagtgcttagggccaaattggaggtcattgtcagggttagggaaaggtctggggccggctcagtaggggagtaggaatcaagggaagcaatcagcatcaggggcaagctgactgtttagatgggcagcagggttg

SEQ ID NO: 565 - DNA, 22 bp, synthetic construct
  source 1..22: mol_type = other DNA
ccgctcgttaaaaatgatctcc

SEQ ID NO: 566 - DNA, 22 bp, synthetic construct
  source 1..22: mol_type = other DNA
cgactacatgtctccaacatcc

SEQ ID NO: 567 - DNA, 15 bp, synthetic construct
  source 1..15: mol_type = other DNA
tgcccgaacatttgc

SEQ ID NO: 568 - RNA, 318 nt, synthetic construct
  source 1..318: mol_type = other RNA
ttgaatgaggcttcagtactttacagaatcgttgcctgcacatcttggaaacacttgctgggattacttcttcaggttaacccaacagaaggctcgagaaggtatattgctgttgacagtgagcgacacactacaattgatatcaaatagtgaagccacagatgtatttgatatcaattgtagtgtgttgcctactgcctcggaattcaaggggctactttaggagcaattatcttgtttactaaaactgaataccttgctatctctttgatacatttttacaaagctgaattaaaatggtataaattaaatcacttt

SEQ ID NO: 569 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..21,25^26): mod_base = OTHER; note = phosphorothioate linkage
tgttcaatcattcgggataagagttc

SEQ ID NO: 570 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..22,25^26): mod_base = OTHER; note = phosphorothioate linkage
tgttcaatcattcgggataagagttc

SEQ ID NO: 571 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base 1..26: mod_base = OTHER; note = phosphorothioate linkage
cgaatctacccacatctgttcaatca

SEQ ID NO: 572 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,4..23,25^26): mod_base = OTHER; note = phosphorothioate linkage
tgttcaatcattcgggataagagttc

SEQ ID NO: 573 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,5..22,25^26): mod_base = OTHER; note = phosphorothioate linkage
tgttcaatcattcgggataagagttc

SEQ ID NO: 574 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base 1..26: mod_base = OTHER; note = phosphorothioate linkage
cacgaatctacccccatccatgtact

SEQ ID NO: 575 - DNA, 26 bp, synthetic construct
  source 1..26: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base 1..26: mod_base = OTHER; note = phosphorothioate linkage
cacgaatctaccccatccatgtactc

SEQ ID NO: 576 - DNA, 26 bp, synthetic construct
  source 1..26: mol_type = other DNA
  modified_base order(2..5,7..8,12,14..18,20..22,25..26): mod_base = OTHER; note = 2 prime-O-methoxyethyl nucleoside
  modified_base order(1,6,9..11,13,19,23..24): mod_base = OTHER; note = 2 prime-O-methoxyethyl-5-methylcytidine
  modified_base 1..26: mod_base = OTHER; note = phosphorothioate linkage
cgaatctacccacgagttctttccag

SEQ ID NO: 577 - DNA, 26 bp, synthetic construct
  source 1..26: mol_type = other DNA
  modified_base order(2..5,7..8,12,14..21,23..25): mod_base = OTHER; note = 2 prime-O-methoxyethyl nucleoside
  modified_base order(1,6,9..11,13,22,26): mod_base = OTHER; note = 2 prime-O-methoxyethyl-5-methylcytidine
  modified_base 1..26: mod_base = OTHER; note = phosphorothioate linkage
cgaatctacccactaagagttctttc

SEQ ID NO: 578 - DNA, 26 bp, synthetic construct
  source 1..26: mol_type = other DNA
  modified_base order(3,5..8,10..11,14..23,25..26): mod_base = OTHER; note = 2 prime-O-methoxyethyl nucleoside
  modified_base order(1..2,4,9,12..13,24): mod_base = OTHER; note = 2 prime-O-methoxyethyl-5-methylcytidine
  modified_base 1..26: mod_base = OTHER; note = phosphorothioate linkage
ccacgaatctaccgataagagttctt

SEQ ID NO: 579 - DNA, 26 bp, synthetic construct
  source 1..26: mol_type = other DNA
  modified_base order(2,4..7,9..10,14..24,26): mod_base = OTHER; note = 2 prime-O-methoxyethyl nucleoside
  modified_base order(1,3,8,11..13,25): mod_base = OTHER; note = 2 prime-O-methoxyethyl-5-methylcytidine
  modified_base 1..26: mod_base = OTHER; note = phosphorothioate linkage
cacgaatctacccggataagagttct

SEQ ID NO: 580 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base 1..26: mod_base = OTHER; note = phosphorothioate linkage
ccacgaatctaccggataagagttct

SEQ ID NO: 581 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base 1..26: mod_base = OTHER; note = phosphorothioate linkage
tgttcaatcattcgggataagagttc

SEQ ID NO: 582 - DNA, 26 bp, synthetic construct
  source 1..26: mol_type = other DNA
  modified_base order(1..4,6..7,11,14..25): mod_base = OTHER; note = 2 prime-O-methoxyethyl nucleoside
  modified_base order(5,8..10,12..13,26): mod_base = OTHER; note = 2 prime-O-methoxyethyl-5-methylcytidine
  modified_base 1..26: mod_base = OTHER; note = phosphorothioate linkage
gaatctacccaccgggataagagttc

SEQ ID NO: 583 - DNA, 26 bp, synthetic construct
  source 1..26: mol_type = other DNA
  modified_base order(2..5,7..8,12,14..25): mod_base = OTHER; note = 2 prime-O-methoxyethyl nucleoside
  modified_base order(1,6,9..11,13,26): mod_base = OTHER; note = 2 prime-O-methoxyethyl-5-methylcytidine
  modified_base 1..26: mod_base = OTHER; note = phosphorothioate linkage
cgaatctacccacgggataagagttc

SEQ ID NO: 584 - DNA, 26 bp, synthetic construct
  source 1..26: mol_type = other DNA
  modified_base order(1,3..6,8..9,13..25): mod_base = OTHER; note = 2 prime-O-methoxyethyl nucleoside
  modified_base order(2,7,10..12,26): mod_base = OTHER; note = 2 prime-O-methoxyethyl-5-methylcytidine
  modified_base 1..26: mod_base = OTHER; note = phosphorothioate linkage
acgaatctacccagggataagagttc

SEQ ID NO: 585 - DNA, 26 bp, synthetic construct
  source 1..26: mol_type = other DNA
  modified_base order(2,4..7,9..10,14..25): mod_base = OTHER; note = 2 prime-O-methoxyethyl nucleoside
  modified_base order(1,3,8,11..13,26): mod_base = OTHER; note = 2 prime-O-methoxyethyl-5-methylcytidine
  modified_base 1..26: mod_base = OTHER; note = phosphorothioate linkage
cacgaatctacccgggataagagttc

SEQ ID NO: 586 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base 1..26: mod_base = OTHER; note = phosphorothioate linkage
ccacgaatctaccgggataagagttc

SEQ ID NO: 587 - DNA, 26 bp, synthetic construct
  source 1..26: mol_type = other DNA
  modified_base order(2..4,7,9..12,14..25): mod_base = OTHER; note = 2 prime-O-methoxyethyl nucleoside
  modified_base order(1,5..6,8,13,26): mod_base = OTHER; note = 2 prime-O-methoxyethyl-5-methylcytidine
  modified_base 1..26: mod_base = OTHER; note = phosphorothioate linkage
ctagccacgaatcgggataagagttc

SEQ ID NO: 588 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base 1..26: mod_base = OTHER; note = phosphorothioate linkage
ccatccatcatccgggataagagttc

SEQ ID NO: 589 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base 1..26: mod_base = OTHER; note = phosphorothioate linkage
gcatttattcaacggggataagagtt

SEQ ID NO: 590 - DNA, 26 bp, synthetic construct
  source 1..26: mol_type = other DNA
  modified_base order(3,6..7,9,11..12,14..26): mod_base = OTHER; note = 2 prime-O-methoxyethyl nucleoside
  modified_base order(1..2,4..5,8,10,13): mod_base = OTHER; note = 2 prime-O-methoxyethyl-5-methylcytidine
  modified_base 1..26: mod_base = OTHER; note = phosphorothioate linkage
ccaccaactcatcggggataagagtt

SEQ ID NO: 591 - DNA, 26 bp, synthetic construct
  source 1..26: mol_type = other DNA
  modified_base order(1..4,6..7,11,14..26): mod_base = OTHER; note = 2 prime-O-methoxyethyl nucleoside
  modified_base order(5,8..10,12..13): mod_base = OTHER; note = 2 prime-O-methoxyethyl-5-methylcytidine
  modified_base 1..26: mod_base = OTHER; note = phosphorothioate linkage
gaatctacccaccggggataagagtt

SEQ ID NO: 592 - DNA, 26 bp, synthetic construct
  source 1..26: mol_type = other DNA
  modified_base order(2..5,7..8,12,14..26): mod_base = OTHER; note = 2 prime-O-methoxyethyl nucleoside
  modified_base order(1,6,9..11,13): mod_base = OTHER; note = 2 prime-O-methoxyethyl-5-methylcytidine
  modified_base 1..26: mod_base = OTHER; note = phosphorothioate linkage
cgaatctacccacggggataagagtt

SEQ ID NO: 593 - DNA, 26 bp, synthetic construct
  source 1..26: mol_type = other DNA
  modified_base order(2,4..7,9..10,14..26): mod_base = OTHER; note = 2 prime-O-methoxyethyl nucleoside
  modified_base order(1,3,8,11..13): mod_base = OTHER; note = 2 prime-O-methoxyethyl-5-methylcytidine
  modified_base 1..26: mod_base = OTHER; note = phosphorothioate linkage
cacgaatctacccggggataagagtt

SEQ ID NO: 594 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base 1..26: mod_base = OTHER; note = phosphorothioate linkage
ccacgaatctaccggggataagagtt

SEQ ID NO: 595 - DNA, 26 bp, synthetic construct
  source 1..26: mol_type = other DNA
  modified_base order(1,4,6..9,11..12,14..26): mod_base = OTHER; note = 2 prime-O-methoxyethyl nucleoside
  modified_base order(2..3,5,10,13): mod_base = OTHER; note = 2 prime-O-methoxyethyl-5-methylcytidine
  modified_base 1..26: mod_base = OTHER; note = phosphorothioate linkage
gccacgaatctacggggataagagtt

SEQ ID NO: 596 - DNA, 26 bp, synthetic construct
  source 1..26: mol_type = other DNA
  modified_base order(2..5,7..8,12,16..26): mod_base = OTHER; note = 2 prime-O-methoxyethyl nucleoside
  modified_base order(1,6,9..11,13..15): mod_base = OTHER; note = 2 prime-O-methoxyethyl-5-methylcytidine
  modified_base 1..26: mod_base = OTHER; note = phosphorothioate linkage
cgaatctacccaccctggggataaga

SEQ ID NO: 597 - DNA, 26 bp, synthetic construct
  source 1..26: mol_type = other DNA
  modified_base order(1,3..6,8..9,13..14,17..26): mod_base = OTHER; note = 2 prime-O-methoxyethyl nucleoside
  modified_base order(2,7,10..12,15..16): mod_base = OTHER; note = 2 prime-O-methoxyethyl-5-methylcytidine
  modified_base 1..26: mod_base = OTHER; note = phosphorothioate linkage
acgaatctacccatcctggggataag

SEQ ID NO: 598 - DNA, 26 bp, synthetic construct
  source 1..26: mol_type = other DNA
  modified_base order(2..5,7..8,12,14..16,19..26): mod_base = OTHER; note = 2 prime-O-methoxyethyl nucleoside
  modified_base order(1,6,9..11,13,17..18): mod_base = OTHER; note = 2 prime-O-methoxyethyl-5-methylcytidine
  modified_base 1..26: mod_base = OTHER; note = phosphorothioate linkage
cgaatctacccacgttcctggggata

SEQ ID NO: 599 - DNA, 26 bp, synthetic construct
  source 1..26: mol_type = other DNA
  modified_base order(2,4..7,9..10,14..16,19..26): mod_base = OTHER; note = 2 prime-O-methoxyethyl nucleoside
  modified_base order(1,3,8,11..13,17..18): mod_base = OTHER; note = 2 prime-O-methoxyethyl-5-methylcytidine
  modified_base 1..26: mod_base = OTHER; note = phosphorothioate linkage
cacgaatctacccgttcctggggata

SEQ ID NO: 600 - DNA, 26 bp, synthetic construct
  source 1..26: mol_type = other DNA
  modified_base order(2..4,7,9..12,14..16,19..26): mod_base = OTHER; note = 2 prime-O-methoxyethyl nucleoside
  modified_base order(1,5..6,8,13,17..18): mod_base = OTHER; note = 2 prime-O-methoxyethyl-5-methylcytidine
  modified_base 1..26: mod_base = OTHER; note = phosphorothioate linkage
ctagccacgaatcgttcctggggata

SEQ ID NO: 601 - DNA, 26 bp, synthetic construct
  source 1..26: mol_type = other DNA
  modified_base order(2..5,7..8,12,14..18,21..26): mod_base = OTHER; note = 2 prime-O-methoxyethyl nucleoside
  modified_base order(1,6,9..11,13,19..20): mod_base = OTHER; note = 2 prime-O-methoxyethyl-5-methylcytidine
  modified_base 1..26: mod_base = OTHER; note = phosphorothioate linkage
cgaatctacccactagttcctgggga

SEQ ID NO: 602 - DNA, 26 bp, synthetic construct
  source 1..26: mol_type = other DNA
  modified_base order(2..4,7,9..12,14..18,21..26): mod_base = OTHER; note = 2 prime-O-methoxyethyl nucleoside
  modified_base order(1,5..6,8,13,19..20): mod_base = OTHER; note = 2 prime-O-methoxyethyl-5-methylcytidine
  modified_base 1..26: mod_base = OTHER; note = phosphorothioate linkage
ctagccacgaatctagttcctgggga

SEQ ID NO: 603 - DNA, 26 bp, synthetic construct
  source 1..26: mol_type = other DNA
  modified_base order(1,3..6,8..9,13,15..19,22..26): mod_base = OTHER; note = 2 prime-O-methoxyethyl nucleoside
  modified_base order(2,7,10..12,14,20..21): mod_base = OTHER; note = 2 prime-O-methoxyethyl-5-methylcytidine
  modified_base 1..26: mod_base = OTHER; note = phosphorothioate linkage
acgaatctacccactagttcctgggg

SEQ ID NO: 604 - DNA, 26 bp, synthetic construct
  source 1..26: mol_type = other DNA
  modified_base order(1..2,4..6,9,11..13,15..19,22..26): mod_base = OTHER; note = 2 prime-O-methoxyethyl nucleoside
  modified_base order(3,7..8,10,14,20..21): mod_base = OTHER; note = 2 prime-O-methoxyethyl-5-methylcytidine
  modified_base 1..26: mod_base = OTHER; note = phosphorothioate linkage
atctagccacgaactagttcctgggg

SEQ ID NO: 605 - DNA, 24 bp, synthetic construct
  source 1..24: mol_type = other DNA
  modified_base order(1..4,6..7,11,13,15..18,20..22,24): mod_base = OTHER; note = 2 prime-O-methoxyethyl nucleoside
  modified_base order(5,8..10,12,14,19,23): mod_base = OTHER; note = 2 prime-O-methoxyethyl-5-methylcytidine
  modified_base 1..24: mod_base = OTHER; note = phosphorothioate linkage
gaatctacccactctgttcaatca

SEQ ID NO: 606 - DNA, 24 bp, synthetic construct
  source 1..24: mol_type = other DNA
  modified_base order(2..5,7..8,12..13,15..18,20..22,24): mod_base = OTHER; note = 2 prime-O-methoxyethyl nucleoside
  modified_base order(1,6,9..11,14,19,23): mod_base = OTHER; note = 2 prime-O-methoxyethyl-5-methylcytidine
  modified_base 1..24: mod_base = OTHER; note = phosphorothioate linkage
cgaatctacccatctgttcaatca

SEQ ID NO: 607 - DNA, 24 bp, synthetic construct
  source 1..24: mol_type = other DNA
  modified_base order(1..4,6..7,11,13..14,16..19,21..23): mod_base = OTHER; note = 2 prime-O-methoxyethyl nucleoside
  modified_base order(5,8..10,12,15,20,24): mod_base = OTHER; note = 2 prime-O-methoxyethyl-5-methylcytidine
  modified_base 1..24: mod_base = OTHER; note = phosphorothioate linkage
gaatctacccacatctgttcaatc

SEQ ID NO: 608 - DNA, 24 bp, synthetic construct
  source 1..24: mol_type = other DNA
  modified_base order(2..5,7..8,12..14,16..19,21..23): mod_base = OTHER; note = 2 prime-O-methoxyethyl nucleoside
  modified_base order(1,6,9..11,15,20,24): mod_base = OTHER; note = 2 prime-O-methoxyethyl-5-methylcytidine
  modified_base 1..24: mod_base = OTHER; note = phosphorothioate linkage
cgaatctacccaatctgttcaatc

SEQ ID NO: 609 - DNA, 24 bp, synthetic construct
  source 1..24: mol_type = other DNA
  modified_base order(1..3,6..7,11,13,15,17..18,21..22): mod_base = OTHER; note = 2 prime-O-methoxyethyl nucleoside
  modified_base order(5,9..10,14,19,23): mod_base = OTHER; note = 2 prime-O-methoxyethyl-5-methylcytidine
  modified_base order(4,16,20,24): mod_base = OTHER; note = 2 prime-4 prime methylene bridge nucleoside
  modified_base order(8,12): mod_base = OTHER; note = 2 prime-4 prime methylene bridge 5-methylcytidine
  modified_base 1..24: mod_base = OTHER; note = phosphorothioate linkage
gaatctacccactctgttcaatca

SEQ ID NO: 610 - DNA, 24 bp, synthetic construct
  source 1..24: mol_type = other DNA
  modified_base order(2..3,5,7,13,15,17..18,21..22): mod_base = OTHER; note = 2 prime-O-methoxyethyl nucleoside
  modified_base order(1,6,9..11,14,19,23): mod_base = OTHER; note = 2 prime-O-methoxyethyl-5-methylcytidine
  modified_base order(4,8,12,16,20,24): mod_base = OTHER; note = 2 prime-4 prime methylene bridge nucleoside
  modified_base 1..24: mod_base = OTHER; note = phosphorothioate linkage
cgaatctacccatctgttcaatca

SEQ ID NO: 611 - DNA, 24 bp, synthetic construct
  source 1..24: mol_type = other DNA
  modified_base order(1..3,6..7,11,13..14,17..19,21..23): mod_base = OTHER; note = 2 prime-O-methoxyethyl nucleoside
  modified_base order(5,9..10,15): mod_base = OTHER; note = 2 prime-O-methoxyethyl-5-methylcytidine
  modified_base order(4,16): mod_base = OTHER; note = 2 prime-4 prime methylene bridge nucleoside
  modified_base order(8,12,20,24): mod_base = OTHER; note = 2 prime-4 prime methylene bridge 5-methylcytidine
  modified_base 1..24: mod_base = OTHER; note = phosphorothioate linkage
gaatctacccacatctgttcaatc

SEQ ID NO: 612 - DNA, 24 bp, synthetic construct
  source 1..24: mol_type = other DNA
  modified_base order(2..3,5,7,13..14,17..19,21..23): mod_base = OTHER; note = 2 prime-O-methoxyethyl nucleoside
  modified_base order(1,6,9..11,15): mod_base = OTHER; note = 2 prime-O-methoxyethyl-5-methylcytidine
  modified_base order(4,8,12,16): mod_base = OTHER; note = 2 prime-4 prime methylene bridge nucleoside
  modified_base order(20,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 613 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1^2,7..20,25^26): mod_base = OTHER; note = phosphorothioate linkage
cacgaatctacccccatccatgtact

SEQ ID NO: 614 - DNA, 26 bp, synthetic construct
  source 1..26: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base order(1^2,7..20,25^26): mod_base = OTHER; note = phosphorothioate linkage
cacgaatctaccccatccatgtactc

SEQ ID NO: 615 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1^2,7..20,25^26): mod_base = OTHER; note = phosphorothioate linkage
ccatccatcatccgggataagagttc

SEQ ID NO: 616 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,7..20,25^26): mod_base = OTHER; note = phosphorothioate linkage
tgttcaatcattcgggataagagttc

SEQ ID NO: 617 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1^2,7..12,15..20,25^26): mod_base = OTHER; note = phosphorothioate linkage
cacgaatctacccccatccatgtact

SEQ ID NO: 618 - DNA, 26 bp, synthetic construct
  source 1..26: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base order(1^2,7..12,15..20,25^26): mod_base = OTHER; note = phosphorothioate linkage
cacgaatctaccccatccatgtactc

SEQ ID NO: 619 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1^2,7..12,15..20,25^26): mod_base = OTHER; note = phosphorothioate linkage
ccatccatcatccgggataagagttc

SEQ ID NO: 620 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,7..12,15..20,25^26): mod_base = OTHER; note = phosphorothioate linkage
tgttcaatcattcgggataagagttc

SEQ ID NO: 621 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1..10,17..26): mod_base = OTHER; note = phosphorothioate linkage
cacgaatctacccccatccatgtact

SEQ ID NO: 622 - DNA, 26 bp, synthetic construct
  source 1..26: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base order(1..10,17..26): mod_base = OTHER; note = phosphorothioate linkage
cacgaatctaccccatccatgtactc

SEQ ID NO: 623 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1..10,17..26): mod_base = OTHER; note = phosphorothioate linkage
ccatccatcatccgggataagagttc

SEQ ID NO: 624 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..10,17..26): mod_base = OTHER; note = phosphorothioate linkage
tgttcaatcattcgggataagagttc

SEQ ID NO: 625 - DNA, 26 bp, synthetic construct
  source 1..26: mol_type = other DNA
  modified_base order(2,4..7,9..10,17,20..24,26): mod_base = OTHER; note = 2 prime-O-methoxyethyl nucleoside
  modified_base order(1,3,8,18..19,25): mod_base = OTHER; note = 2 prime-O-methoxyethyl-5-methylcytidine
  modified_base 16: mod_base = OTHER; note = 2 prime-4 prime methylene bridge nucleoside
  modified_base 11..15: mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 626 - DNA, 26 bp, synthetic construct
  source 1..26: mol_type = other DNA
  modified_base order(2,4..7,9..10,19..23,25): mod_base = OTHER; note = 2 prime-O-methoxyethyl nucleoside
  modified_base order(1,3,8,17..18,24,26): mod_base = OTHER; note = 2 prime-O-methoxyethyl-5-methylcytidine
  modified_base 15..16: mod_base = OTHER; note = 2 prime-4 prime methylene bridge nucleoside
  modified_base 11..14: mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 627 - DNA, 26 bp, synthetic construct
  source 1..26: mol_type = other DNA
  modified_base order(3..4,7..8,10,17..25): mod_base = OTHER; note = 2 prime-O-methoxyethyl nucleoside
  modified_base order(1..2,5..6,9,26): mod_base = OTHER; note = 2 prime-O-methoxyethyl-5-methylcytidine
  modified_base order(11,14..16): mod_base = OTHER; note = 2 prime-4 prime methylene bridge nucleoside
  modified_base 12..13: mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 628 - DNA, 26 bp, synthetic construct
  source 1..26: mol_type = other DNA
  modified_base order(1..4,6..8,10,17..25): mod_base = OTHER; note = 2 prime-O-methoxyethyl nucleoside
  modified_base order(5,9,26): mod_base = OTHER; note = 2 prime-O-methoxyethyl-5-methylcytidine
  modified_base order(11..12,14..16): mod_base = OTHER; note = 2 prime-4 prime methylene bridge nucleoside
  modified_base 13: mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 629 - DNA, 26 bp, synthetic construct
  source 1..26: mol_type = other DNA
  modified_base order(5..7,9..10,16..17,20..22): mod_base = OTHER; note = 2 prime-O-methoxyethyl nucleoside
  modified_base order(8,11..15,18..19): mod_base = OTHER; note = 2 prime-O-methoxyethyl-5-methylcytidine
  modified_base order(2,4,23..24,26): mod_base = OTHER; note = 2 prime-4 prime methylene bridge nucleoside
  modified_base order(1,3,25): mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 630 - DNA, 26 bp, synthetic construct
  source 1..26: mol_type = other DNA
  modified_base order(5..7,9..10,15..16,19..22): mod_base = OTHER; note = 2 prime-O-methoxyethyl nucleoside
  modified_base order(8,11..14,17..18): mod_base = OTHER; note = 2 prime-O-methoxyethyl-5-methylcytidine
  modified_base order(2,4,23,25): mod_base = OTHER; note = 2 prime-4 prime methylene bridge nucleoside
  modified_base order(1,3,24,26): mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 631 - DNA, 26 bp, synthetic construct
  source 1..26: mol_type = other DNA
  modified_base order(7..8,10..11,14..22): mod_base = OTHER; note = 2 prime-O-methoxyethyl nucleoside
  modified_base order(5..6,9,12..13): mod_base = OTHER; note = 2 prime-O-methoxyethyl-5-methylcytidine
  modified_base order(3..4,23..25): mod_base = OTHER; note = 2 prime-4 prime methylene bridge nucleoside
  modified_base order(1..2,26): mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 632 - DNA, 26 bp, synthetic construct
  source 1..26: mol_type = other DNA
  modified_base order(6..8,10..12,14..22): mod_base = OTHER; note = 2 prime-O-methoxyethyl nucleoside
  modified_base order(5,9,13): mod_base = OTHER; note = 2 prime-O-methoxyethyl-5-methylcytidine
  modified_base order(1..4,23..25): mod_base = OTHER; note = 2 prime-4 prime methylene bridge nucleoside
  modified_base 26: mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 633 - DNA, 26 bp, synthetic construct
  source 1..26: mol_type = other DNA
  modified_base order(5..7,9..10,16..17,20..22): mod_base = OTHER; note = 2 prime-O-methoxyethyl nucleoside
  modified_base order(8,11,18..19): mod_base = OTHER; note = 2 prime-O-methoxyethyl-5-methylcytidine
  modified_base order(2,4,23..24,26): mod_base = OTHER; note = 2 prime-4 prime methylene bridge nucleoside
  modified_base order(1,3,12..15,25): mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 634 - DNA, 26 bp, synthetic construct
  source 1..26: mol_type = other DNA
  modified_base order(5..7,9..10,16,19..22): mod_base = OTHER; note = 2 prime-O-methoxyethyl nucleoside
  modified_base order(8,11,17..18): mod_base = OTHER; note = 2 prime-O-methoxyethyl-5-methylcytidine
  modified_base order(2,4,15,23,25): mod_base = OTHER; note = 2 prime-4 prime methylene bridge nucleoside
  modified_base order(1,3,12..14,24,26): mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 635 - DNA, 26 bp, synthetic construct
  source 1..26: mol_type = other DNA
  modified_base order(7..8,10..11,16..22): mod_base = OTHER; note = 2 prime-O-methoxyethyl nucleoside
  modified_base order(5..6,9): mod_base = OTHER; note = 2 prime-O-methoxyethyl-5-methylcytidine
  modified_base order(3..4,14..15,23..25): mod_base = OTHER; note = 2 prime-4 prime methylene bridge nucleoside
  modified_base order(1..2,12..13,26): mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 636 - DNA, 26 bp, synthetic construct
  source 1..26: mol_type = other DNA
  modified_base order(6..8,10..11,16..22): mod_base = OTHER; note = 2 prime-O-methoxyethyl nucleoside
  modified_base order(5,9): mod_base = OTHER; note = 2 prime-O-methoxyethyl-5-methylcytidine
  modified_base order(1..4,12,14..15,23..25): mod_base = OTHER; note = 2 prime-4 prime methylene bridge nucleoside
  modified_base order(13,26): mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 637 - DNA, 26 bp, synthetic construct
  source 1..26: mol_type = other DNA
  modified_base order(4..7,9..10,17,20..23): mod_base = OTHER; note = 2 prime-O-methoxyethyl nucleoside
  modified_base order(8,18..19): mod_base = OTHER; note = 2 prime-O-methoxyethyl-5-methylcytidine
  modified_base order(2,16,24,26): mod_base = OTHER; note = 2 prime-4 prime methylene bridge nucleoside
  modified_base order(1,3,11..15,25): mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 638 - DNA, 26 bp, synthetic construct
  source 1..26: mol_type = other DNA
  modified_base order(4..7,9..10,19..23): mod_base = OTHER; note = 2 prime-O-methoxyethyl nucleoside
  modified_base order(8,17..18): mod_base = OTHER; note = 2 prime-O-methoxyethyl-5-methylcytidine
  modified_base order(2,15..16,25): mod_base = OTHER; note = 2 prime-4 prime methylene bridge nucleoside
  modified_base order(1,3,11..14,24,26): mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 639 - DNA, 26 bp, synthetic construct
  source 1..26: mol_type = other DNA
  modified_base order(4,7..8,10,17..23): mod_base = OTHER; note = 2 prime-O-methoxyethyl nucleoside
  modified_base order(5..6,9): mod_base = OTHER; note = 2 prime-O-methoxyethyl-5-methylcytidine
  modified_base order(3,11,14..16,24..25): mod_base = OTHER; note = 2 prime-4 prime methylene bridge nucleoside
  modified_base order(1..2,12..13,26): mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 640 - DNA, 26 bp, synthetic construct
  source 1..26: mol_type = other DNA
  modified_base order(4,6..8,10,17..23): mod_base = OTHER; note = 2 prime-O-methoxyethyl nucleoside
  modified_base order(5,9): mod_base = OTHER; note = 2 prime-O-methoxyethyl-5-methylcytidine
  modified_base order(1..3,11..12,14..16,24..25): mod_base = OTHER; note = 2 prime-4 prime methylene bridge nucleoside
  modified_base order(13,26): mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 641 - DNA, 26 bp, synthetic construct
  source 1..26: mol_type = other DNA
  modified_base order(5..7,9..10,17,20..24,26): mod_base = OTHER; note = 2 prime-O-methoxyethyl nucleoside
  modified_base order(8,18..19,25): mod_base = OTHER; note = 2 prime-O-methoxyethyl-5-methylcytidine
  modified_base order(2,4,16): mod_base = OTHER; note = 2 prime-4 prime methylene bridge nucleoside
  modified_base order(1,3,11..15): mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 642 - DNA, 26 bp, synthetic construct
  source 1..26: mol_type = other DNA
  modified_base order(5..7,9..10,19..23,25): mod_base = OTHER; note = 2 prime-O-methoxyethyl nucleoside
  modified_base order(8,17..18,24,26): mod_base = OTHER; note = 2 prime-O-methoxyethyl-5-methylcytidine
  modified_base order(2,4,15..16): mod_base = OTHER; note = 2 prime-4 prime methylene bridge nucleoside
  modified_base order(1,3,11..14): mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 643 - DNA, 26 bp, synthetic construct
  source 1..26: mol_type = other DNA
  modified_base order(7..8,10,17..25): mod_base = OTHER; note = 2 prime-O-methoxyethyl nucleoside
  modified_base order(5..6,9,26): mod_base = OTHER; note = 2 prime-O-methoxyethyl-5-methylcytidine
  modified_base order(3..4,11,14..16): mod_base = OTHER; note = 2 prime-4 prime methylene bridge nucleoside
  modified_base order(1..2,12..13): mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 644 - DNA, 26 bp, synthetic construct
  source 1..26: mol_type = other DNA
  modified_base order(6..8,10,17..25): mod_base = OTHER; note = 2 prime-O-methoxyethyl nucleoside
  modified_base order(5,9,26): mod_base = OTHER; note = 2 prime-O-methoxyethyl-5-methylcytidine
  modified_base order(1..4,11..12,14..16): mod_base = OTHER; note = 2 prime-4 prime methylene bridge nucleoside
  modified_base 13: mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 645 - DNA, 26 bp, synthetic construct
  source 1..26: mol_type = other DNA
  modified_base order(2,4..7,9..10,17,20..22): mod_base = OTHER; note = 2 prime-O-methoxyethyl nucleoside
  modified_base order(1,3,8,18..19): mod_base = OTHER; note = 2 prime-O-methoxyethyl-5-methylcytidine
  modified_base order(16,23..24,26): mod_base = OTHER; note = 2 prime-4 prime methylene bridge nucleoside
  modified_base order(11..15,25): mod_base = OTHER; note = 2 prime-4 prime methylene bridge 5-methylcytidine
  modified_base 1..26: mod_base = OTHER; note = phosphorothioate linkage
cacgaatctacccccatccatgtact

SEQ ID NO: 646 - DNA, 26 bp, synthetic construct
  source 1..26: mol_type = other DNA
  modified_base order(2,4..7,9..10,19..22): mod_base = OTHER; note = 2 prime-O-methoxyethyl nucleoside
  modified_base order(1,3,8,17..18): mod_base = OTHER; note = 2 prime-O-methoxyethyl-5-methylcytidine
  modified_base order(15..16,23,25): mod_base = OTHER; note = 2 prime-4 prime methylene bridge nucleoside
  modified_base order(11..14,24,26): mod_base = OTHER; note = 2 prime-4 prime methylene bridge 5-methylcytidine
  modified_base 1..26: mod_base = OTHER; note = phosphorothioate linkage
cacgaatctaccccatccatgtactc

SEQ ID NO: 647 - DNA, 26 bp, synthetic construct
  source 1..26: mol_type = other DNA
  modified_base order(3..4,7..8,10,17..22): mod_base = OTHER; note = 2 prime-O-methoxyethyl nucleoside
  modified_base order(1..2,5..6,9): mod_base = OTHER; note = 2 prime-O-methoxyethyl-5-methylcytidine
  modified_base order(11,14..16,23..25): mod_base = OTHER; note = 2 prime-4 prime methylene bridge nucleoside
  modified_base order(12..13,26): mod_base = OTHER; note = 2 prime-4 prime methylene bridge 5-methylcytidine
  modified_base 1..26: mod_base = OTHER; note = phosphorothioate linkage
ccatccatcatccgggataagagttc

SEQ ID NO: 648 - DNA, 26 bp, synthetic construct
  source 1..26: mol_type = other DNA
  modified_base order(1..4,6..8,10,17..22): mod_base = OTHER; note = 2 prime-O-methoxyethyl nucleoside
  modified_base order(5,9): mod_base = OTHER; note = 2 prime-O-methoxyethyl-5-methylcytidine
  modified_base order(11..12,14..16,23..25): mod_base = OTHER; note = 2 prime-4 prime methylene bridge nucleoside
  modified_base order(13,26): mod_base = OTHER; note = 2 prime-4 prime methylene bridge 5-methylcytidine
  modified_base 1..26: mod_base = OTHER; note = phosphorothioate linkage
tgttcaatcattcgggataagagttc

SEQ ID NO: 649 - DNA, 26 bp, synthetic construct
  source 1..26: mol_type = other DNA
  modified_base order(2..5,7..8,17..20,22..24,26): mod_base = OTHER; note = 2 prime-O-methoxyethyl nucleoside
  modified_base order(1,6,9..10,21,25): mod_base = OTHER; note = 2 prime-O-methoxyethyl-5-methylcytidine
  modified_base order(12,14..15): mod_base = OTHER; note = 2 prime-4 prime methylene bridge nucleoside
  modified_base order(11,13,16): mod_base = OTHER; note = 2 prime-4 prime methylene bridge 5-methylcytidine
  modified_base 1..26: mod_base = OTHER; note = phosphorothioate linkage
cgaatctacccacatctgttcaatca

SEQ ID NO: 650 - DNA, 26 bp, synthetic construct
  source 1..26: mol_type = other DNA
  modified_base order(5,7..8,12,14..15,17..20,22): mod_base = OTHER; note = 2 prime-O-methoxyethyl nucleoside
  modified_base order(6,9..11,13,16,21): mod_base = OTHER; note = 2 prime-O-methoxyethyl-5-methylcytidine
  modified_base order(2..4,23..24,26): mod_base = OTHER; note = 2 prime-4 prime methylene bridge nucleoside
  modified_base order(1,25): mod_base = OTHER; note = 2 prime-4 prime methylene bridge 5-methylcytidine
  modified_base 1..26: mod_base = OTHER; note = phosphorothioate linkage
cgaatctacccacatctgttcaatca

SEQ ID NO: 651 - DNA, 26 bp, synthetic construct
  source 1..26: mol_type = other DNA
  modified_base order(5,7..8,17..20,22): mod_base = OTHER; note = 2 prime-O-methoxyethyl nucleoside
  modified_base order(6,9..11,16,21): mod_base = OTHER; note = 2 prime-O-methoxyethyl-5-methylcytidine
  modified_base order(2..4,12,14..15,23..24,26): mod_base = OTHER; note = 2 prime-4 prime methylene bridge nucleoside
  modified_base order(1,13,25): mod_base = OTHER; note = 2 prime-4 prime methylene bridge 5-methylcytidine
  modified_base 1..26: mod_base = OTHER; note = phosphorothioate linkage
cgaatctacccacatctgttcaatca

SEQ ID NO: 652 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base 1..24: mod_base = OTHER; note = phosphorothioate linkage
acgaatctacccccatccatgtac

SEQ ID NO: 653 - DNA, 25 bp, synthetic construct
  source 1..25: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24): mod_base = OTHER; note = 2 prime-O-methoxyethyl-5-methylcytidine
  modified_base 1..25: mod_base = OTHER; note = phosphorothioate linkage
cacgaatctaccccatccatgtact

SEQ ID NO: 654 - DNA, 25 bp, synthetic construct
  source 1..25: mol_type = other DNA
  modified_base order(1,3..6,8..9,15..16,19..23,25): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base 1..25: mod_base = OTHER; note = phosphorothioate linkage
acgaatctacccccatccatgtact

SEQ ID NO: 655 - DNA, 25 bp, synthetic construct
  source 1..25: mol_type = other DNA
  modified_base order(2,4..7,9..10,16..17,20..24): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base 1..25: mod_base = OTHER; note = phosphorothioate linkage
cacgaatctacccccatccatgtac

SEQ ID NO: 656 - DNA, 27 bp, synthetic construct
  source 1..27: mol_type = other DNA
  modified_base order(2,4..7,9..10,14,17..18,21..25,27): mod_base = OTHER; note = 2 prime-O-methoxyethyl nucleoside
  modified_base order(1,3,8,11..13,15..16,19..20,26): mod_base = OTHER; note = 2 prime-O-methoxyethyl-5-methylcytidine
  modified_base 1..27: mod_base = OTHER; note = phosphorothioate linkage
cacgaatctaccctccatccatgtact

SEQ ID NO: 657 - DNA, 27 bp, synthetic construct
  source 1..27: mol_type = other DNA
  modified_base order(2,4..7,9..10,14,17..18,21..25,27): mod_base = OTHER; note = 2 prime-O-methoxyethyl nucleoside
  modified_base order(1,3,8,11..13,15..16,19..20,26): mod_base = OTHER; note = 2 prime-O-methoxyethyl-5-methylcytidine
  modified_base 1..27: mod_base = OTHER; note = phosphorothioate linkage
cacgaatctacccaccatccatgtact

SEQ ID NO: 658 - DNA, 24 bp, synthetic construct
  source 1..24: mol_type = other DNA
  modified_base order(1,3..6,8..9,14..15,18..22,24): mod_base = OTHER; note = 2 prime-O-methoxyethyl nucleoside
  modified_base order(2,7,10..13,16..17,23): mod_base = OTHER; note = 2 prime-O-methoxyethyl-5-methylcytidine
  modified_base 1..24: mod_base = OTHER; note = phosphorothioate linkage
acgaatctaccccatccatgtact

SEQ ID NO: 659 - DNA, 25 bp, synthetic construct
  source 1..25: mol_type = other DNA
  modified_base order(2,4..7,9..10,14..15,18..22,24): mod_base = OTHER; note = 2 prime-O-methoxyethyl nucleoside
  modified_base order(1,3,8,11..13,16..17,23,25): mod_base = OTHER; note = 2 prime-O-methoxyethyl-5-methylcytidine
  modified_base 1..25: mod_base = OTHER; note = phosphorothioate linkage
cacgaatctacccatccatgtactc

SEQ ID NO: 660 - DNA, 25 bp, synthetic construct
  source 1..25: mol_type = other DNA
  modified_base order(1,3..6,8..9,14..15,18..22,24): mod_base = OTHER; note = 2 prime-O-methoxyethyl nucleoside
  modified_base order(2,7,10..13,16..17,23,25): mod_base = OTHER; note = 2 prime-O-methoxyethyl-5-methylcytidine
  modified_base 1..25: mod_base = OTHER; note = phosphorothioate linkage
acgaatctaccccatccatgtactc

SEQ ID NO: 661 - DNA, 27 bp, synthetic construct
  source 1..27: mol_type = other DNA
  modified_base order(2,4..7,9..10,15..16,19..23,25,27): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base 1..27: mod_base = OTHER; note = phosphorothioate linkage
cacgaatctaccccatccatgtactca

SEQ ID NO: 662 - DNA, 24 bp, synthetic construct
  source 1..24: mol_type = other DNA
  modified_base order(3..4,7..8,10..11,13..24): mod_base = OTHER; note = 2 prime-O-methoxyethyl nucleoside
  modified_base order(1..2,5..6,9,12): mod_base = OTHER; note = 2 prime-O-methoxyethyl-5-methylcytidine
  modified_base 1..24: mod_base = OTHER; note = phosphorothioate linkage
ccatccatcatcgggataagagtt

SEQ ID NO: 663 - DNA, 24 bp, synthetic construct
  source 1..24: mol_type = other DNA
  modified_base order(3..4,7..8,10..11,13..23): mod_base = OTHER; note = 2 prime-O-methoxyethyl nucleoside
  modified_base order(1..2,5..6,9,12,24): mod_base = OTHER; note = 2 prime-O-methoxyethyl-5-methylcytidine
  modified_base 1..24: mod_base = OTHER; note = phosphorothioate linkage
ccatccatcatcggataagagttc

SEQ ID NO: 664 - DNA, 24 bp, synthetic construct
  source 1..24: mol_type = other DNA
  modified_base order(2..3,6..7,9..10,13..24): mod_base = OTHER; note = 2 prime-O-methoxyethyl nucleoside
  modified_base order(1,4..5,8,11..12): mod_base = OTHER; note = 2 prime-O-methoxyethyl-5-methylcytidine
  modified_base 1..24: mod_base = OTHER; note = phosphorothioate linkage
catccatcatccgggataagagtt

SEQ ID NO: 665 - DNA, 24 bp, synthetic construct
  source 1..24: mol_type = other DNA
  modified_base order(2..3,6..7,9..10,13..23): mod_base = OTHER; note = 2 prime-O-methoxyethyl nucleoside
  modified_base order(1,4..5,8,11..12,24): mod_base = OTHER; note = 2 prime-O-methoxyethyl-5-methylcytidine
  modified_base 1..24: mod_base = OTHER; note = phosphorothioate linkage
catccatcatccggataagagttc

SEQ ID NO: 666 - DNA, 25 bp, synthetic construct
  source 1..25: mol_type = other DNA
  modified_base order(3..4,7..8,10..11,13..24): mod_base = OTHER; note = 2 prime-O-methoxyethyl nucleoside
  modified_base order(1..2,5..6,9,12,25): mod_base = OTHER; note = 2 prime-O-methoxyethyl-5-methylcytidine
  modified_base 1..25: mod_base = OTHER; note = phosphorothioate linkage
ccatccatcatcgggataagagttc

SEQ ID NO: 667 - DNA, 25 bp, synthetic construct
  source 1..25: mol_type = other DNA
  modified_base order(2..3,6..7,9..10,13..24): mod_base = OTHER; note = 2 prime-O-methoxyethyl nucleoside
  modified_base order(1,4..5,8,11..12,25): mod_base = OTHER; note = 2 prime-O-methoxyethyl-5-methylcytidine
  modified_base 1..25: mod_base = OTHER; note = phosphorothioate linkage
catccatcatccgggataagagttc

SEQ ID NO: 668 - DNA, 25 bp, synthetic construct
  source 1..25: mol_type = other DNA
  modified_base order(3..4,7..8,10..11,14..25): mod_base = OTHER; note = 2 prime-O-methoxyethyl nucleoside
  modified_base order(1..2,5..6,9,12..13): mod_base = OTHER; note = 2 prime-O-methoxyethyl-5-methylcytidine
  modified_base 1..25: mod_base = OTHER; note = phosphorothioate linkage
ccatccatcatccgggataagagtt

SEQ ID NO: 669 - DNA, 25 bp, synthetic construct
  source 1..25: mol_type = other DNA
  modified_base order(3..4,7..8,10..11,14..24): mod_base = OTHER; note = 2 prime-O-methoxyethyl nucleoside
  modified_base order(1..2,5..6,9,12..13,25): mod_base = OTHER; note = 2 prime-O-methoxyethyl-5-methylcytidine
  modified_base 1..25: mod_base = OTHER; note = phosphorothioate linkage
ccatccatcatccggataagagttc

SEQ ID NO: 670 - DNA, 27 bp, synthetic construct
  source 1..27: mol_type = other DNA
  modified_base order(3..4,7..8,10..11,14..26): mod_base = OTHER; note = 2 prime-O-methoxyethyl nucleoside
  modified_base order(1..2,5..6,9,12..13,27): mod_base = OTHER; note = 2 prime-O-methoxyethyl-5-methylcytidine
  modified_base 1..27: mod_base = OTHER; note = phosphorothioate linkage
ccatccatcatccggggataagagttc

SEQ ID NO: 671 - DNA, 27 bp, synthetic construct
  source 1..27: mol_type = other DNA
  modified_base order(3..4,7..8,10..11,14..25,27): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base 1..27: mod_base = OTHER; note = phosphorothioate linkage
ccatccatcatccgggataagagttct

SEQ ID NO: 672 - DNA, 27 bp, synthetic construct
  source 1..27: mol_type = other DNA
  modified_base order(1,4..5,8..9,11..12,15..26): mod_base = OTHER; note = 2 prime-O-methoxyethyl nucleoside
  modified_base order(2..3,6..7,10,13..14,27): mod_base = OTHER; note = 2 prime-O-methoxyethyl-5-methylcytidine
  modified_base 1..27: mod_base = OTHER; note = phosphorothioate linkage
tccatccatcatccgggataagagttc

SEQ ID NO: 673 - DNA, 24 bp, synthetic construct
  source 1..24: mol_type = other DNA
  modified_base order(1..3,5..7,9..11,13..24): mod_base = OTHER; note = 2 prime-O-methoxyethyl nucleoside
  modified_base order(4,8,12): mod_base = OTHER; note = 2 prime-O-methoxyethyl-5-methylcytidine
  modified_base 1..24: mod_base = OTHER; note = phosphorothioate linkage
gttcaatcattcgggataagagtt

SEQ ID NO: 674 - DNA, 24 bp, synthetic construct
  source 1..24: mol_type = other DNA
  modified_base order(1..3,5..7,9..11,13..23): mod_base = OTHER; note = 2 prime-O-methoxyethyl nucleoside
  modified_base order(4,8,12,24): mod_base = OTHER; note = 2 prime-O-methoxyethyl-5-methylcytidine
  modified_base 1..24: mod_base = OTHER; note = phosphorothioate linkage
gttcaatcattcggataagagttc

SEQ ID NO: 675 - DNA, 25 bp, synthetic construct
  source 1..25: mol_type = other DNA
  modified_base order(1..3,5..7,9..11,13..24): mod_base = OTHER; note = 2 prime-O-methoxyethyl nucleoside
  modified_base order(4,8,12,25): mod_base = OTHER; note = 2 prime-O-methoxyethyl-5-methylcytidine
  modified_base 1..25: mod_base = OTHER; note = phosphorothioate linkage
gttcaatcattcgggataagagttc

SEQ ID NO: 676 - DNA, 25 bp, synthetic construct
  source 1..25: mol_type = other DNA
  modified_base order(1..4,6..8,10..12,14..24): mod_base = OTHER; note = 2 prime-O-methoxyethyl nucleoside
  modified_base order(5,9,13,25): mod_base = OTHER; note = 2 prime-O-methoxyethyl-5-methylcytidine
  modified_base 1..25: mod_base = OTHER; note = phosphorothioate linkage
tgttcaatcattcggataagagttc

SEQ ID NO: 677 - DNA, 27 bp, synthetic construct
  source 1..27: mol_type = other DNA
  modified_base order(1..4,6..8,10..12,14..25,27): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base 1..27: mod_base = OTHER; note = phosphorothioate linkage
tgttcaatcattcgggataagagttct

SEQ ID NO: 678 - DNA, 25 bp, synthetic construct
  source 1..25: mol_type = other DNA
  modified_base order(1..4,6..7,11,13..14,16..19,21..23,25): mod_base = OTHER; note = 2 prime-O-methoxyethyl nucleoside
  modified_base order(5,8..10,12,15,20,24): mod_base = OTHER; note = 2 prime-O-methoxyethyl-5-methylcytidine
  modified_base 1..25: mod_base = OTHER; note = phosphorothioate linkage
gaatctacccacatctgttcaatca

SEQ ID NO: 679 - DNA, 25 bp, synthetic construct
  source 1..25: mol_type = other DNA
  modified_base order(2..5,7..8,12,14..15,17..20,22..24): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base 1..25: mod_base = OTHER; note = phosphorothioate linkage
cgaatctacccacatctgttcaatc

SEQ ID NO: 680 - DNA, 27 bp, synthetic construct
  source 1..27: mol_type = other DNA
  modified_base order(2..5,7..8,12,15..16,18..21,23..25,27): mod_base = OTHER; note = 2 prime-O-methoxyethyl nucleoside
  modified_base order(1,6,9..11,13..14,17,22,26): mod_base = OTHER; note = 2 prime-O-methoxyethyl-5-methylcytidine
  modified_base 1..27: mod_base = OTHER; note = phosphorothioate linkage
cgaatctacccaccatctgttcaatca

SEQ ID NO: 681 - DNA, 27 bp, synthetic construct
  source 1..27: mol_type = other DNA
  modified_base order(2,4..7,9..10,17..18,21..25,27): mod_base = OTHER; note = 2 prime-O-methoxyethyl nucleoside
  modified_base order(1,3,8,11..16,19..20,26): mod_base = OTHER; note = 2 prime-O-methoxyethyl-5-methylcytidine
  modified_base 1..27: mod_base = OTHER; note = phosphorothioate linkage
cacgaatctaccccccatccatgtact

SEQ ID NO: 682 - DNA, 27 bp, synthetic construct
  source 1..27: mol_type = other DNA
  modified_base order(2,4..7,9..10,14,17..18,21..25,27): mod_base = OTHER; note = 2 prime-O-methoxyethyl nucleoside
  modified_base order(1,3,8,11..13,15..16,19..20,26): mod_base = OTHER; note = 2 prime-O-methoxyethyl-5-methylcytidine
  modified_base 1..27: mod_base = OTHER; note = phosphorothioate linkage
cacgaatctacccgccatccatgtact

SEQ ID NO: 683 - DNA, 27 bp, synthetic construct
  source 1..27: mol_type = other DNA
  modified_base order(2,4..7,9..10,14,16..17,20..24,26): mod_base = OTHER; note = 2 prime-O-methoxyethyl nucleoside
  modified_base order(1,3,8,11..13,15,18..19,25,27): mod_base = OTHER; note = 2 prime-O-methoxyethyl-5-methylcytidine
  modified_base 1..27: mod_base = OTHER; note = phosphorothioate linkage
cacgaatctaccctcatccatgtactc

SEQ ID NO: 684 - DNA, 27 bp, synthetic construct
  source 1..27: mol_type = other DNA
  modified_base order(2,4..7,9..10,14,16..17,20..24,26): mod_base = OTHER; note = 2 prime-O-methoxyethyl nucleoside
  modified_base order(1,3,8,11..13,15,18..19,25,27): mod_base = OTHER; note = 2 prime-O-methoxyethyl-5-methylcytidine
  modified_base 1..27: mod_base = OTHER; note = phosphorothioate linkage
cacgaatctacccgcatccatgtactc

SEQ ID NO: 685 - DNA, 27 bp, synthetic construct
  source 1..27: mol_type = other DNA
  modified_base order(1..4,6..8,10..12,15..26): mod_base = OTHER; note = 2 prime-O-methoxyethyl nucleoside
  modified_base order(5,9,13..14,27): mod_base = OTHER; note = 2 prime-O-methoxyethyl-5-methylcytidine
  modified_base 1..27: mod_base = OTHER; note = phosphorothioate linkage
tgttcaatcattccgggataagagttc

SEQ ID NO: 686 - DNA, 27 bp, synthetic construct
  source 1..27: mol_type = other DNA
  modified_base order(3..4,7..8,10..11,15..26): mod_base = OTHER; note = 2 prime-O-methoxyethyl nucleoside
  modified_base order(1..2,5..6,9,12..14,27): mod_base = OTHER; note = 2 prime-O-methoxyethyl-5-methylcytidine
  modified_base 1..27: mod_base = OTHER; note = phosphorothioate linkage
ccatccatcatcccgggataagagttc

SEQ ID NO: 687 - DNA, 28 bp, synthetic construct
  source 1..28: mol_type = other DNA
  modified_base order(2,4..7,9..10,15,18..19,22..26,28): mod_base = OTHER; note = 2 prime-O-methoxyethyl nucleoside
  modified_base order(1,3,8,11..14,16..17,20..21,27): mod_base = OTHER; note = 2 prime-O-methoxyethyl-5-methylcytidine
  modified_base 1..28: mod_base = OTHER; note = phosphorothioate linkage
cacgaatctaccccaccatccatgtact

SEQ ID NO: 688 - DNA, 28 bp, synthetic construct
  source 1..28: mol_type = other DNA
  modified_base order(2,4..7,9..10,14,18..19,22..26,28): mod_base = OTHER; note = 2 prime-O-methoxyethyl nucleoside
  modified_base order(1,3,8,11..13,15..17,20..21,27): mod_base = OTHER; note = 2 prime-O-methoxyethyl-5-methylcytidine
  modified_base 1..28: mod_base = OTHER; note = phosphorothioate linkage
cacgaatctaccctcccatccatgtact

SEQ ID NO: 689 - DNA, 28 bp, synthetic construct
  source 1..28: mol_type = other DNA
  modified_base order(2,4..7,9..10,18..19,22..26,28): mod_base = OTHER; note = 2 prime-O-methoxyethyl nucleoside
  modified_base order(1,3,8,11..17,20..21,27): mod_base = OTHER; note = 2 prime-O-methoxyethyl-5-methylcytidine
  modified_base 1..28: mod_base = OTHER; note = phosphorothioate linkage
cacgaatctacccccccatccatgtact

SEQ ID NO: 690 - DNA, 28 bp, synthetic construct
  source 1..28: mol_type = other DNA
  modified_base order(2,4..7,9..10,15,17..18,21..25,27): mod_base = OTHER; note = 2 prime-O-methoxyethyl nucleoside
  modified_base order(1,3,8,11..14,16,19..20,26,28): mod_base = OTHER; note = 2 prime-O-methoxyethyl-5-methylcytidine
  modified_base 1..28: mod_base = OTHER; note = phosphorothioate linkage
cacgaatctacccctcatccatgtactc

SEQ ID NO: 691 - DNA, 28 bp, synthetic construct
  source 1..28: mol_type = other DNA
  modified_base order(2,4..7,9..10,14..15,17..18,21..25,27): mod_base = OTHER; note = 2 prime-O-methoxyethyl nucleoside
  modified_base order(1,3,8,11..13,16,19..20,26,28): mod_base = OTHER; note = 2 prime-O-methoxyethyl-5-methylcytidine
  modified_base 1..28: mod_base = OTHER; note = phosphorothioate linkage
cacgaatctacccttcatccatgtactc

SEQ ID NO: 692 - DNA, 28 bp, synthetic construct
  source 1..28: mol_type = other DNA
  modified_base order(1..4,6..8,10..12,15..27): mod_base = OTHER; note = 2 prime-O-methoxyethyl nucleoside
  modified_base order(5,9,13..14,28): mod_base = OTHER; note = 2 prime-O-methoxyethyl-5-methylcytidine
  modified_base 1..28: mod_base = OTHER; note = phosphorothioate linkage
tgttcaatcattccagggataagagttc

SEQ ID NO: 693 - DNA, 28 bp, synthetic construct
  source 1..28: mol_type = other DNA
  modified_base order(1..4,6..8,10..12,15..27): mod_base = OTHER; note = 2 prime-O-methoxyethyl nucleoside
  modified_base order(5,9,13..14,28): mod_base = OTHER; note = 2 prime-O-methoxyethyl-5-methylcytidine
  modified_base 1..28: mod_base = OTHER; note = phosphorothioate linkage
tgttcaatcattcctgggataagagttc

SEQ ID NO: 694 - DNA, 28 bp, synthetic construct
  source 1..28: mol_type = other DNA
  modified_base order(3..4,7..8,10..11,15..27): mod_base = OTHER; note = 2 prime-O-methoxyethyl nucleoside
  modified_base order(1..2,5..6,9,12..14,28): mod_base = OTHER; note = 2 prime-O-methoxyethyl-5-methylcytidine
  modified_base 1..28: mod_base = OTHER; note = phosphorothioate linkage
ccatccatcatcccagggataagagttc

SEQ ID NO: 695 - DNA, 28 bp, synthetic construct
  source 1..28: mol_type = other DNA
  modified_base order(3..4,7..8,10..11,14,16..27): mod_base = OTHER; note = 2 prime-O-methoxyethyl nucleoside
  modified_base order(1..2,5..6,9,12..13,15,28): mod_base = OTHER; note = 2 prime-O-methoxyethyl-5-methylcytidine
  modified_base 1..28: mod_base = OTHER; note = phosphorothioate linkage
ccatccatcatcctcgggataagagttc

SEQ ID NO: 696 - DNA, 28 bp, synthetic construct
  source 1..28: mol_type = other DNA
  modified_base order(3..4,7..8,10..11,14..27): mod_base = OTHER; note = 2 prime-O-methoxyethyl nucleoside
  modified_base order(1..2,5..6,9,12..13,28): mod_base = OTHER; note = 2 prime-O-methoxyethyl-5-methylcytidine
  modified_base 1..28: mod_base = OTHER; note = phosphorothioate linkage
ccatccatcatccttgggataagagttc

SEQ ID NO: 697 - DNA, 24 bp, synthetic construct
  source 1..24: mol_type = other DNA
  modified_base order(1,3..6,8..9,16,19..23): mod_base = OTHER; note = 2 prime-O-methoxyethyl nucleoside
  modified_base order(2,7,17..18,24): mod_base = OTHER; note = 2 prime-O-methoxyethyl-5-methylcytidine
  modified_base 15: mod_base = OTHER; note = 2 prime-4 prime methylene bridge nucleoside
  modified_base 10..14: mod_base = OTHER; note = 2 prime-4 prime methylene bridge 5-methylcytidine
  modified_base 1..24: mod_base = OTHER; note = phosphorothioate linkage
acgaatctacccccatccatgtac

SEQ ID NO: 698 - DNA, 24 bp, synthetic construct
  source 1..24: mol_type = other DNA
  modified_base order(1,3..6,8..9,18..22,24): mod_base = OTHER; note = 2 prime-O-methoxyethyl nucleoside
  modified_base order(2,7,16..17,23): mod_base = OTHER; note = 2 prime-O-methoxyethyl-5-methylcytidine
  modified_base 14..15: mod_base = OTHER; note = 2 prime-4 prime methylene bridge nucleoside
  modified_base 10..13: mod_base = OTHER; note = 2 prime-4 prime methylene bridge 5-methylcytidine
  modified_base 1..24: mod_base = OTHER; note = phosphorothioate linkage
acgaatctaccccatccatgtact

SEQ ID NO: 699 - DNA, 24 bp, synthetic construct
  source 1..24: mol_type = other DNA
  modified_base order(3..4,7..8,16..24): mod_base = OTHER; note = 2 prime-O-methoxyethyl nucleoside
  modified_base order(1..2,5..6,9): mod_base = OTHER; note = 2 prime-O-methoxyethyl-5-methylcytidine
  modified_base order(10..11,13..15): mod_base = OTHER; note = 2 prime-4 prime methylene bridge nucleoside
  modified_base 12: mod_base = OTHER; note = 2 prime-4 prime methylene bridge 5-methylcytidine
  modified_base 1..24: mod_base = OTHER; note = phosphorothioate linkage
ccatccatcatcgggataagagtt

SEQ ID NO: 700 - DNA, 24 bp, synthetic construct
  source 1..24: mol_type = other DNA
  modified_base order(3..4,7..8,16..23): mod_base = OTHER; note = 2 prime-O-methoxyethyl nucleoside
  modified_base order(1..2,5..6,9,24): mod_base = OTHER; note = 2 prime-O-methoxyethyl-5-methylcytidine
  modified_base order(10..11,13..15): mod_base = OTHER; note = 2 prime-4 prime methylene bridge nucleoside
  modified_base 12: mod_base = OTHER; note = 2 prime-4 prime methylene bridge 5-methylcytidine
  modified_base 1..24: mod_base = OTHER; note = phosphorothioate linkage
ccatccatcatcggataagagttc

SEQ ID NO: 701 - DNA, 24 bp, synthetic construct
  source 1..24: mol_type = other DNA
  modified_base order(2..3,6..7,9,16..24): mod_base = OTHER; note = 2 prime-O-methoxyethyl nucleoside
  modified_base order(1,4..5,8): mod_base = OTHER; note = 2 prime-O-methoxyethyl-5-methylcytidine
  modified_base order(10,13..15): mod_base = OTHER; note = 2 prime-4 prime methylene bridge nucleoside
  modified_base 11..12: mod_base = OTHER; note = 2 prime-4 prime methylene bridge 5-methylcytidine
  modified_base 1..24: mod_base = OTHER; note = phosphorothioate linkage
catccatcatccgggataagagtt

SEQ ID NO: 702 - DNA, 24 bp, synthetic construct
  source 1..24: mol_type = other DNA
  modified_base order(2..3,6..7,9,16..23): mod_base = OTHER; note = 2 prime-O-methoxyethyl nucleoside
  modified_base order(1,4..5,8,24): mod_base = OTHER; note = 2 prime-O-methoxyethyl-5-methylcytidine
  modified_base order(10,13..15): mod_base = OTHER; note = 2 prime-4 prime methylene bridge nucleoside
  modified_base 11..12: mod_base = OTHER; note = 2 prime-4 prime methylene bridge 5-methylcytidine
  modified_base 1..24: mod_base = OTHER; note = phosphorothioate linkage
catccatcatccggataagagttc

SEQ ID NO: 703 - DNA, 24 bp, synthetic construct
  source 1..24: mol_type = other DNA
  modified_base order(1..3,5..7,9,16..24): mod_base = OTHER; note = 2 prime-O-methoxyethyl nucleoside
  modified_base order(4,8): mod_base = OTHER; note = 2 prime-O-methoxyethyl-5-methylcytidine
  modified_base order(10..11,13..15): mod_base = OTHER; note = 2 prime-4 prime methylene bridge nucleoside
  modified_base 12: mod_base = OTHER; note = 2 prime-4 prime methylene bridge 5-methylcytidine
  modified_base 1..24: mod_base = OTHER; note = phosphorothioate linkage
gttcaatcattcgggataagagtt

SEQ ID NO: 704 - DNA, 24 bp, synthetic construct
  source 1..24: mol_type = other DNA
  modified_base order(1..3,5..7,9,16..23): mod_base = OTHER; note = 2 prime-O-methoxyethyl nucleoside
  modified_base order(4,8,24): mod_base = OTHER; note = 2 prime-O-methoxyethyl-5-methylcytidine
  modified_base order(10..11,13..15): mod_base = OTHER; note = 2 prime-4 prime methylene bridge nucleoside
  modified_base 12: mod_base = OTHER; note = 2 prime-4 prime methylene bridge 5-methylcytidine
  modified_base 1..24: mod_base = OTHER; note = phosphorothioate linkage
gttcaatcattcggataagagttc

SEQ ID NO: 705 - DNA, 24 bp, synthetic construct
  source 1..24: mol_type = other DNA
  modified_base order(2..5,7..8,16..18,20..22,24): mod_base = OTHER; note = 2 prime-O-methoxyethyl nucleoside
  modified_base order(1,6,9,19,23): mod_base = OTHER; note = 2 prime-O-methoxyethyl-5-methylcytidine
  modified_base order(12..13,15): mod_base = OTHER; note = 2 prime-4 prime methylene bridge nucleoside
  modified_base order(10..11,14): mod_base = OTHER; note = 2 prime-4 prime methylene bridge 5-methylcytidine
  modified_base 1..24: mod_base = OTHER; note = phosphorothioate linkage
cgaatctacccatctgttcaatca

SEQ ID NO: 706 - DNA, 24 bp, synthetic construct
  source 1..24: mol_type = other DNA
  modified_base order(2..5,7..8,16..19,21..23): mod_base = OTHER; note = 2 prime-O-methoxyethyl nucleoside
  modified_base order(1,6,9,20,24): mod_base = OTHER; note = 2 prime-O-methoxyethyl-5-methylcytidine
  modified_base 12..14: mod_base = OTHER; note = 2 prime-4 prime methylene bridge nucleoside
  modified_base order(10..11,15): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 707 - DNA, 24 bp, synthetic construct
  source 1..24: mol_type = other DNA
  modified_base order(5..6,8..9,15..16,19..20): mod_base = OTHER; note = 2 prime-O-methoxyethyl nucleoside
  modified_base order(7,10,17..18): mod_base = OTHER; note = 2 prime-O-methoxyethyl-5-methylcytidine
  modified_base order(1,3..4,21..23): mod_base = OTHER; note = 2 prime-4 prime methylene bridge nucleoside
  modified_base order(2,11..14,24): mod_base = OTHER; note = 2 prime-4 prime methylene bridge 5-methylcytidine
  modified_base 1..24: mod_base = OTHER; note = phosphorothioate linkage
acgaatctacccccatccatgtac

SEQ ID NO: 708 - DNA, 24 bp, synthetic construct
  source 1..24: mol_type = other DNA
  modified_base order(5..6,8..9,15,18..20): mod_base = OTHER; note = 2 prime-O-methoxyethyl nucleoside
  modified_base order(7,10,16..17): mod_base = OTHER; note = 2 prime-O-methoxyethyl-5-methylcytidine
  modified_base order(1,3..4,14,21..22,24): mod_base = OTHER; note = 2 prime-4 prime methylene bridge nucleoside
  modified_base order(2,11..13,23): mod_base = OTHER; note = 2 prime-4 prime methylene bridge 5-methylcytidine
  modified_base 1..24: mod_base = OTHER; note = phosphorothioate linkage
acgaatctaccccatccatgtact

SEQ ID NO: 709 - DNA, 24 bp, synthetic construct
  source 1..24: mol_type = other DNA
  modified_base order(7..8,10,15..20): mod_base = OTHER; note = 2 prime-O-methoxyethyl nucleoside
  modified_base order(5..6,9): mod_base = OTHER; note = 2 prime-O-methoxyethyl-5-methylcytidine
  modified_base order(3..4,11,13..14,21..24): mod_base = OTHER; note = 2 prime-4 prime methylene bridge nucleoside
  modified_base order(1..2,12): mod_base = OTHER; note = 2 prime-4 prime methylene bridge 5-methylcytidine
  modified_base 1..24: mod_base = OTHER; note = phosphorothioate linkage
ccatccatcatcgggataagagtt

SEQ ID NO: 710 - DNA, 24 bp, synthetic construct
  source 1..24: mol_type = other DNA
  modified_base order(7..8,10,15..20): mod_base = OTHER; note = 2 prime-O-methoxyethyl nucleoside
  modified_base order(5..6,9): mod_base = OTHER; note = 2 prime-O-methoxyethyl-5-methylcytidine
  modified_base order(3..4,11,13..14,21..23): mod_base = OTHER; note = 2 prime-4 prime methylene bridge nucleoside
  modified_base order(1..2,12,24): mod_base = OTHER; note = 2 prime-4 prime methylene bridge 5-methylcytidine
  modified_base 1..24: mod_base = OTHER; note = phosphorothioate linkage
ccatccatcatcggataagagttc

SEQ ID NO: 711 - DNA, 24 bp, synthetic construct
  source 1..24: mol_type = other DNA
  modified_base order(6..7,9..10,15..20): mod_base = OTHER; note = 2 prime-O-methoxyethyl nucleoside
  modified_base order(5,8): mod_base = OTHER; note = 2 prime-O-methoxyethyl-5-methylcytidine
  modified_base order(2..3,13..14,21..24): mod_base = OTHER; note = 2 prime-4 prime methylene bridge nucleoside
  modified_base order(1,4,11..12): mod_base = OTHER; note = 2 prime-4 prime methylene bridge 5-methylcytidine
  modified_base 1..24: mod_base = OTHER; note = phosphorothioate linkage
catccatcatccgggataagagtt

SEQ ID NO: 712 - DNA, 24 bp, synthetic construct
  source 1..24: mol_type = other DNA
  modified_base order(6..7,9..10,15..20): mod_base = OTHER; note = 2 prime-O-methoxyethyl nucleoside
  modified_base order(5,8): mod_base = OTHER; note = 2 prime-O-methoxyethyl-5-methylcytidine
  modified_base order(2..3,13..14,21..23): mod_base = OTHER; note = 2 prime-4 prime methylene bridge nucleoside
  modified_base order(1,4,11..12,24): mod_base = OTHER; note = 2 prime-4 prime methylene bridge 5-methylcytidine
  modified_base 1..24: mod_base = OTHER; note = phosphorothioate linkage
catccatcatccggataagagttc

SEQ ID NO: 713 - DNA, 24 bp, synthetic construct
  source 1..24: mol_type = other DNA
  modified_base order(5..7,9..10,15..20): mod_base = OTHER; note = 2 prime-O-methoxyethyl nucleoside
  modified_base 8: mod_base = OTHER; note = 2 prime-O-methoxyethyl-5-methylcytidine
  modified_base order(1..3,11,13..14,21..24): mod_base = OTHER; note = 2 prime-4 prime methylene bridge nucleoside
  modified_base order(4,12): mod_base = OTHER; note = 2 prime-4 prime methylene bridge 5-methylcytidine
  modified_base 1..24: mod_base = OTHER; note = phosphorothioate linkage
gttcaatcattcgggataagagtt

SEQ ID NO: 714 - DNA, 24 bp, synthetic construct
  source 1..24: mol_type = other DNA
  modified_base order(5..7,9..10,15..20): mod_base = OTHER; note = 2 prime-O-methoxyethyl nucleoside
  modified_base 8: mod_base = OTHER; note = 2 prime-O-methoxyethyl-5-methylcytidine
  modified_base order(1..3,11,13..14,21..23): mod_base = OTHER; note = 2 prime-4 prime methylene bridge nucleoside
  modified_base order(4,12,24): mod_base = OTHER; note = 2 prime-4 prime methylene bridge 5-methylcytidine
  modified_base 1..24: mod_base = OTHER; note = phosphorothioate linkage
gttcaatcattcggataagagttc

SEQ ID NO: 715 - DNA, 24 bp, synthetic construct
  source 1..24: mol_type = other DNA
  modified_base order(5,7..8,15..18,20): mod_base = OTHER; note = 2 prime-O-methoxyethyl nucleoside
  modified_base order(6,9..10,19): mod_base = OTHER; note = 2 prime-O-methoxyethyl-5-methylcytidine
  modified_base order(2..4,12..13,21..22,24): mod_base = OTHER; note = 2 prime-4 prime methylene bridge nucleoside
  modified_base order(1,11,14,23): mod_base = OTHER; note = 2 prime-4 prime methylene bridge 5-methylcytidine
  modified_base 1..24: mod_base = OTHER; note = phosphorothioate linkage
cgaatctacccatctgttcaatca

SEQ ID NO: 716 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 717 - DNA, 20 bp, synthetic construct
  source 1..20: mol_type = other DNA
  modified_base order(2..5,7..8,11..12,15..19): mod_base = OTHER; note = 2 prime-O-methoxyethyl nucleoside
  modified_base order(1,6,9..10,13..14,20): mod_base = OTHER; note = 2 prime-O-methoxyethyl-5-methylcytidine
  modified_base 1..20: mod_base = OTHER; note = phosphorothioate linkage
cgaatctaccatccatgtac

SEQ ID NO: 718 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,7..20,25^26): mod_base = OTHER; note = phosphorothioate linkage
cgaatctacccacatctgttcaatca

SEQ ID NO: 719 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,7..12,15..20,25^26): mod_base = OTHER; note = phosphorothioate linkage
cgaatctacccacatctgttcaatca

SEQ ID NO: 720 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..10,17..26): mod_base = OTHER; note = phosphorothioate linkage
cgaatctacccacatctgttcaatca

SEQ ID NO: 721 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..20,25^26): mod_base = OTHER; note = phosphorothioate linkage
cgaatctacccacatctgttcaatca

SEQ ID NO: 722 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,7..26): mod_base = OTHER; note = phosphorothioate linkage
cgaatctacccacatctgttcaatca

SEQ ID NO: 723 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,6..21,25^26): mod_base = OTHER; note = phosphorothioate linkage
cgaatctacccacatctgttcaatca

SEQ ID NO: 724 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,5..22,25^26): mod_base = OTHER; note = phosphorothioate linkage
cgaatctacccacatctgttcaatca

SEQ ID NO: 725 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,3^4,5^6,7^8,9^10,11^12,13^14,15^16,17^18,19^20,21^22,23^24,25^26): mod_base = OTHER; note = phosphorothioate linkage
cgaatctacccacatctgttcaatca

SEQ ID NO: 726 - DNA, 22 bp, synthetic construct
  source 1..22: mol_type = other DNA
  modified_base order(3,5..6,14..16,18..20): mod_base = OTHER; note = 2 prime-O-methoxyethyl nucleoside
  modified_base order(4,7..9,17): mod_base = OTHER; note = 2 prime-O-methoxyethyl-5-methylcytidine
  modified_base order(1..2,10,13,22): mod_base = OTHER; note = 2 prime-4 prime methylene bridge nucleoside
  modified_base order(11..12,21): mod_base = OTHER; note = 2 prime-4 prime methylene bridge 5-methylcytidine
  modified_base 1..22: mod_base = OTHER; note = phosphorothioate linkage
aatctacccacctgttcaatca

SEQ ID NO: 727 - DNA, 22 bp, synthetic construct
  source 1..22: mol_type = other DNA
  modified_base order(3,5..6,15..18,20): mod_base = OTHER; note = 2 prime-O-methoxyethyl nucleoside
  modified_base order(4,7..9,14,19): mod_base = OTHER; note = 2 prime-O-methoxyethyl-5-methylcytidine
  modified_base order(1..2,10,12..13,21..22): mod_base = OTHER; note = 2 prime-4 prime methylene bridge nucleoside
  modified_base 11: mod_base = OTHER; note = 2 prime-4 prime methylene bridge 5-methylcytidine
  modified_base 1..22: mod_base = OTHER; note = phosphorothioate linkage
aatctacccacatctgttcaat

SEQ ID NO: 728 - DNA, 22 bp, synthetic construct
  source 1..22: mol_type = other DNA
  modified_base order(3..5,7..8,14..16,18..20): mod_base = OTHER; note = 2 prime-O-methoxyethyl nucleoside
  modified_base order(6,9,17): mod_base = OTHER; note = 2 prime-O-methoxyethyl-5-methylcytidine
  modified_base order(2,13,22): mod_base = OTHER; note = 2 prime-4 prime methylene bridge nucleoside
  modified_base order(1,10..12,21): mod_base = OTHER; note = 2 prime-4 prime methylene bridge 5-methylcytidine
  modified_base 1..22: mod_base = OTHER; note = phosphorothioate linkage
cgaatctacccctgttcaatca

SEQ ID NO: 729 - DNA, 22 bp, synthetic construct
  source 1..22: mol_type = other DNA
  modified_base order(3..5,7..8,15..18,20): mod_base = OTHER; note = 2 prime-O-methoxyethyl nucleoside
  modified_base order(6,9,14,19): mod_base = OTHER; note = 2 prime-O-methoxyethyl-5-methylcytidine
  modified_base order(2,12..13,21..22): mod_base = OTHER; note = 2 prime-4 prime methylene bridge nucleoside
  modified_base order(1,10..11): mod_base = OTHER; note = 2 prime-4 prime methylene bridge 5-methylcytidine
  modified_base 1..22: mod_base = OTHER; note = phosphorothioate linkage
cgaatctacccatctgttcaat

SEQ ID NO: 730 - DNA, 26 bp, synthetic construct
  source 1..26: mol_type = other DNA
  modified_base order(1,3..6,8..9,13..15,17..20,22..24,26): mod_base = OTHER; note = 2 prime-O-methoxyethyl nucleoside
  modified_base order(2,7,10..12,16,21,25): mod_base = OTHER; note = 2 prime-O-methoxyethyl-5-methylcytidine
  modified_base 1..26: mod_base = OTHER; note = phosphorothioate linkage
acgaatctacccaatctgttcaatca

SEQ ID NO: 731 - DNA, 26 bp, synthetic construct
  source 1..26: mol_type = other DNA
  modified_base order(2,4..7,9..10,14..15,17..20,22..24,26): mod_base = OTHER; note = 2 prime-O-methoxyethyl nucleoside
  modified_base order(1,3,8,11..13,16,21,25): mod_base = OTHER; note = 2 prime-O-methoxyethyl-5-methylcytidine
  modified_base 1..26: mod_base = OTHER; note = phosphorothioate linkage
cacgaatctacccatctgttcaatca

SEQ ID NO: 732 - DNA, 26 bp, synthetic construct
  source 1..26: mol_type = other DNA
  modified_base order(1..4,6..7,11,14..15,17..20,22..24,26): mod_base = OTHER; note = 2 prime-O-methoxyethyl nucleoside
  modified_base order(5,8..10,12..13,16,21,25): mod_base = OTHER; note = 2 prime-O-methoxyethyl-5-methylcytidine
  modified_base 1..26: mod_base = OTHER; note = phosphorothioate linkage
gaatctacccaccatctgttcaatca

SEQ ID NO: 733 - DNA, 26 bp, synthetic construct
  source 1..26: mol_type = other DNA
  modified_base order(1..3,5..6,10,13..15,17..20,22..24,26): mod_base = OTHER; note = 2 prime-O-methoxyethyl nucleoside
  modified_base order(4,7..9,11..12,16,21,25): mod_base = OTHER; note = 2 prime-O-methoxyethyl-5-methylcytidine
  modified_base 1..26: mod_base = OTHER; note = phosphorothioate linkage
aatctacccaccaatctgttcaatca

SEQ ID NO: 734 - DNA, 26 bp, synthetic construct
  source 1..26: mol_type = other DNA
  modified_base order(2..5,7..8,12,14,16..19,21..23,25..26): mod_base = OTHER; note = 2 prime-O-methoxyethyl nucleoside
  modified_base order(1,6,9..11,13,15,20,24): mod_base = OTHER; note = 2 prime-O-methoxyethyl-5-methylcytidine
  modified_base 1..26: mod_base = OTHER; note = phosphorothioate linkage
cgaatctacccactctgttcaatcat

SEQ ID NO: 735 - DNA, 26 bp, synthetic construct
  source 1..26: mol_type = other DNA
  modified_base order(2..5,7..8,12,14,16..17,19..22,24..26): mod_base = OTHER; note = 2 prime-O-methoxyethyl nucleoside
  modified_base order(1,6,9..11,13,15,18,23): mod_base = OTHER; note = 2 prime-O-methoxyethyl-5-methylcytidine
  modified_base 1..26: mod_base = OTHER; note = phosphorothioate linkage
cgaatctacccactcatctgttcaat

SEQ ID NO: 736 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base 1..26: mod_base = OTHER; note = phosphorothioate linkage
acgaatctacccacatctgttcaatc

SEQ ID NO: 737 - DNA, 26 bp, synthetic construct
  source 1..26: mol_type = other DNA
  modified_base order(1..4,6..7,11,15..16,18..21,23..25): mod_base = OTHER; note = 2 prime-O-methoxyethyl nucleoside
  modified_base order(5,8..10,12..14,17,22,26): mod_base = OTHER; note = 2 prime-O-methoxyethyl-5-methylcytidine
  modified_base 1..26: mod_base = OTHER; note = phosphorothioate linkage
gaatctacccacccatctgttcaatc

SEQ ID NO: 738 - DNA, 26 bp, synthetic construct
  source 1..26: mol_type = other DNA
  modified_base order(1,3..6,8..9,13..14,16..19,21..23,25..26): mod_base = OTHER; note = 2 prime-O-methoxyethyl nucleoside
  modified_base order(2,7,10..12,15,20,24): mod_base = OTHER; note = 2 prime-O-methoxyethyl-5-methylcytidine
  modified_base 1..26: mod_base = OTHER; note = phosphorothioate linkage
acgaatctacccatctgttcaatcat

SEQ ID NO: 739 - DNA, 26 bp, synthetic construct
  source 1..26: mol_type = other DNA
  modified_base order(1..4,6..7,11,14,16..19,21..23,25..26): mod_base = OTHER; note = 2 prime-O-methoxyethyl nucleoside
  modified_base order(5,8..10,12..13,15,20,24): mod_base = OTHER; note = 2 prime-O-methoxyethyl-5-methylcytidine
  modified_base 1..26: mod_base = OTHER; note = phosphorothioate linkage
gaatctacccacctctgttcaatcat

SEQ ID NO: 740 - DNA, 26 bp, synthetic construct
  source 1..26: mol_type = other DNA
  modified_base order(3,5..8,10..11,14,16..18,20..22,24..26): mod_base = OTHER; note = 2 prime-O-methoxyethyl nucleoside
  modified_base order(1..2,4,9,12..13,15,19,23): mod_base = OTHER; note = 2 prime-O-methoxyethyl-5-methylcytidine
  modified_base 1..26: mod_base = OTHER; note = phosphorothioate linkage
ccacgaatctacctcaatcattcatt

SEQ ID NO: 741 - DNA, 26 bp, synthetic construct
  source 1..26: mol_type = other DNA
  modified_base order(2..5,7..8,12,15,17..20,22..24,26): mod_base = OTHER; note = 2 prime-O-methoxyethyl nucleoside
  modified_base order(1,6,9..11,13..14,16,21,25): mod_base = OTHER; note = 2 prime-O-methoxyethyl-5-methylcytidine
  modified_base 1..26: mod_base = OTHER; note = phosphorothioate linkage
cgaatctacccacctctgttcaatca

SEQ ID NO: 742 - DNA, 26 bp, synthetic construct
  source 1..26: mol_type = other DNA
  modified_base order(1,3..6,8..9,13,15,17..20,22..24,26): mod_base = OTHER; note = 2 prime-O-methoxyethyl nucleoside
  modified_base order(2,7,10..12,14,16,21,25): mod_base = OTHER; note = 2 prime-O-methoxyethyl-5-methylcytidine
  modified_base 1..26: mod_base = OTHER; note = phosphorothioate linkage
acgaatctacccactctgttcaatca

SEQ ID NO: 743 - DNA, 26 bp, synthetic construct
  source 1..26: mol_type = other DNA
  modified_base order(2..5,7..8,12..14,16..19,21..23,25..26): mod_base = OTHER; note = 2 prime-O-methoxyethyl nucleoside
  modified_base order(1,6,9..11,15,20,24): mod_base = OTHER; note = 2 prime-O-methoxyethyl-5-methylcytidine
  modified_base 1..26: mod_base = OTHER; note = phosphorothioate linkage
cgaatctacccaatctgttcaatcat

SEQ ID NO: 744 - DNA, 26 bp, synthetic construct
  source 1..26: mol_type = other DNA
  modified_base order(1..4,6..7,11,13..14,16..19,21..23,25..26): mod_base = OTHER; note = 2 prime-O-methoxyethyl nucleoside
  modified_base order(5,8..10,12,15,20,24): mod_base = OTHER; note = 2 prime-O-methoxyethyl-5-methylcytidine
  modified_base 1..26: mod_base = OTHER; note = phosphorothioate linkage
gaatctacccacatctgttcaatcat

SEQ ID NO: 745 - DNA, 22 bp, synthetic construct
  source 1..22: mol_type = other DNA
  modified_base order(1..3,5..6,10,13..16,18..20,22): mod_base = OTHER; note = 2 prime-O-methoxyethyl nucleoside
  modified_base order(4,7..9,11..12,17,21): mod_base = OTHER; note = 2 prime-O-methoxyethyl-5-methylcytidine
  modified_base 1..22: mod_base = OTHER; note = phosphorothioate linkage
aatctacccacctgttcaatca

SEQ ID NO: 746 - DNA, 22 bp, synthetic construct
  source 1..22: mol_type = other DNA
  modified_base order(1..3,5..6,10,12..13,15..18,20..22): mod_base = OTHER; note = 2 prime-O-methoxyethyl nucleoside
  modified_base order(4,7..9,11,14,19): mod_base = OTHER; note = 2 prime-O-methoxyethyl-5-methylcytidine
  modified_base 1..22: mod_base = OTHER; note = phosphorothioate linkage
aatctacccacatctgttcaat

SEQ ID NO: 747 - DNA, 22 bp, synthetic construct
  source 1..22: mol_type = other DNA
  modified_base order(1..3,5..6,10,12,14..17,19..21): mod_base = OTHER; note = 2 prime-O-methoxyethyl nucleoside
  modified_base order(4,7..9,11,13,18,22): mod_base = OTHER; note = 2 prime-O-methoxyethyl-5-methylcytidine
  modified_base 1..22: mod_base = OTHER; note = phosphorothioate linkage
aatctacccactctgttcaatc

SEQ ID NO: 748 - DNA, 22 bp, synthetic construct
  source 1..22: mol_type = other DNA
  modified_base order(2..5,7..8,13..16,18..20,22): mod_base = OTHER; note = 2 prime-O-methoxyethyl nucleoside
  modified_base order(1,6,9..12,17,21): mod_base = OTHER; note = 2 prime-O-methoxyethyl-5-methylcytidine
  modified_base 1..22: mod_base = OTHER; note = phosphorothioate linkage
cgaatctacccctgttcaatca

SEQ ID NO: 749 - DNA, 22 bp, synthetic construct
  source 1..22: mol_type = other DNA
  modified_base order(2..5,7..8,12..13,15..18,20..22): mod_base = OTHER; note = 2 prime-O-methoxyethyl nucleoside
  modified_base order(1,6,9..11,14,19): mod_base = OTHER; note = 2 prime-O-methoxyethyl-5-methylcytidine
  modified_base 1..22: mod_base = OTHER; note = phosphorothioate linkage
cgaatctacccatctgttcaat

SEQ ID NO: 750 - DNA, 22 bp, synthetic construct
  source 1..22: mol_type = other DNA
  modified_base order(2..5,7..8,12,14..17,19..21): mod_base = OTHER; note = 2 prime-O-methoxyethyl nucleoside
  modified_base order(1,6,9..11,13,18,22): mod_base = OTHER; note = 2 prime-O-methoxyethyl-5-methylcytidine
  modified_base 1..22: mod_base = OTHER; note = phosphorothioate linkage
cgaatctaccctctgttcaatc

SEQ ID NO: 751 - DNA, 22 bp, synthetic construct
  source 1..22: mol_type = other DNA
  modified_base order(1..4,6..7,11,13..16,18..20,22): mod_base = OTHER; note = 2 prime-O-methoxyethyl nucleoside
  modified_base order(5,8..10,12,17,21): mod_base = OTHER; note = 2 prime-O-methoxyethyl-5-methylcytidine
  modified_base 1..22: mod_base = OTHER; note = phosphorothioate linkage
gaatctacccactgttcaatca

SEQ ID NO: 752 - DNA, 22 bp, synthetic construct
  source 1..22: mol_type = other DNA
  modified_base order(1..4,6..7,11..13,15..18,20..22): mod_base = OTHER; note = 2 prime-O-methoxyethyl nucleoside
  modified_base order(5,8..10,14,19): mod_base = OTHER; note = 2 prime-O-methoxyethyl-5-methylcytidine
  modified_base 1..22: mod_base = OTHER; note = phosphorothioate linkage
gaatctacccaatctgttcaat

SEQ ID NO: 753 - DNA, 22 bp, synthetic construct
  source 1..22: mol_type = other DNA
  modified_base order(1..4,6..7,11..12,14..17,19..21): mod_base = OTHER; note = 2 prime-O-methoxyethyl nucleoside
  modified_base order(5,8..10,13,18,22): mod_base = OTHER; note = 2 prime-O-methoxyethyl-5-methylcytidine
  modified_base 1..22: mod_base = OTHER; note = phosphorothioate linkage
gaatctacccatctgttcaatc

SEQ ID NO: 754 - DNA, 22 bp, synthetic construct
  source 1..22: mol_type = other DNA
  modified_base order(3,5..6,14..17,19..20): mod_base = OTHER; note = 2 prime-O-methoxyethyl nucleoside
  modified_base order(4,7..9,18): mod_base = OTHER; note = 2 prime-O-methoxyethyl-5-methylcytidine
  modified_base order(1..2,10,12,21): mod_base = OTHER; note = 2 prime-4 prime methylene bridge nucleoside
  modified_base order(11,13,22): mod_base = OTHER; note = 2 prime-4 prime methylene bridge 5-methylcytidine
  modified_base 1..22: mod_base = OTHER; note = phosphorothioate linkage
aatctacccactctgttcaatc

SEQ ID NO: 755 - DNA, 22 bp, synthetic construct
  source 1..22: mol_type = other DNA
  modified_base order(3..5,7..8,14..17,19..20): mod_base = OTHER; note = 2 prime-O-methoxyethyl nucleoside
  modified_base order(6,9,18): mod_base = OTHER; note = 2 prime-O-methoxyethyl-5-methylcytidine
  modified_base order(2,12,21): mod_base = OTHER; note = 2 prime-4 prime methylene bridge nucleoside
  modified_base order(1,10..11,13,22): mod_base = OTHER; note = 2 prime-4 prime methylene bridge 5-methylcytidine
  modified_base 1..22: mod_base = OTHER; note = phosphorothioate linkage
cgaatctaccctctgttcaatc

SEQ ID NO: 756 - DNA, 22 bp, synthetic construct
  source 1..22: mol_type = other DNA
  modified_base order(3..4,6..7,14..16,18..20): mod_base = OTHER; note = 2 prime-O-methoxyethyl nucleoside
  modified_base order(5,8..9,17): mod_base = OTHER; note = 2 prime-O-methoxyethyl-5-methylcytidine
  modified_base order(1..2,11,13,22): mod_base = OTHER; note = 2 prime-4 prime methylene bridge nucleoside
  modified_base order(10,12,21): mod_base = OTHER; note = 2 prime-4 prime methylene bridge 5-methylcytidine
  modified_base 1..22: mod_base = OTHER; note = phosphorothioate linkage
gaatctacccactgttcaatca

SEQ ID NO: 757 - DNA, 22 bp, synthetic construct
  source 1..22: mol_type = other DNA
  modified_base order(3..4,6..7,15..18,20): mod_base = OTHER; note = 2 prime-O-methoxyethyl nucleoside
  modified_base order(5,8..9,14,19): mod_base = OTHER; note = 2 prime-O-methoxyethyl-5-methylcytidine
  modified_base order(1..2,11..13,21..22): mod_base = OTHER; note = 2 prime-4 prime methylene bridge nucleoside
  modified_base 10: mod_base = OTHER; note = 2 prime-4 prime methylene bridge 5-methylcytidine
  modified_base 1..22: mod_base = OTHER; note = phosphorothioate linkage
gaatctacccaatctgttcaat

SEQ ID NO: 758 - DNA, 22 bp, synthetic construct
  source 1..22: mol_type = other DNA
  modified_base order(3..4,6..7,14..17,19..20): mod_base = OTHER; note = 2 prime-O-methoxyethyl nucleoside
  modified_base order(5,8..9,18): mod_base = OTHER; note = 2 prime-O-methoxyethyl-5-methylcytidine
  modified_base order(1..2,11..12,21): mod_base = OTHER; note = 2 prime-4 prime methylene bridge nucleoside
  modified_base order(10,13,22): mod_base = OTHER; note = 2 prime-4 prime methylene bridge 5-methylcytidine
  modified_base 1..22: mod_base = OTHER; note = phosphorothioate linkage
gaatctacccatctgttcaatc

SEQ ID NO: 759 - DNA, 22 bp, synthetic construct
  source 1..22: mol_type = other DNA
  modified_base order(1..4,6..7,11..12,14..17,19..21): mod_base = OTHER; note = 2 prime-O-methoxyethyl nucleoside
  modified_base order(5,8..10,13,18,22): mod_base = OTHER; note = 2 prime-O-methoxyethyl-5-methylcytidine
  modified_base order(1^2,6..17,21^22): mod_base = OTHER; note = phosphorothioate linkage
gaatctacccatctgttcaatc

SEQ ID NO: 760 - DNA, 22 bp, synthetic construct
  source 1..22: mol_type = other DNA
  modified_base order(1..4,6..7,11..12,14..17,19..21): mod_base = OTHER; note = 2 prime-O-methoxyethyl nucleoside
  modified_base order(5,8..10,13,18,22): mod_base = OTHER; note = 2 prime-O-methoxyethyl-5-methylcytidine
  modified_base order(1..16,21^22): mod_base = OTHER; note = phosphorothioate linkage
gaatctacccatctgttcaatc

SEQ ID NO: 761 - DNA, 22 bp, synthetic construct
  source 1..22: mol_type = other DNA
  modified_base order(1..4,6..7,11..12,14..17,19..21): mod_base = OTHER; note = 2 prime-O-methoxyethyl nucleoside
  modified_base order(5,8..10,13,18,22): mod_base = OTHER; note = 2 prime-O-methoxyethyl-5-methylcytidine
  modified_base order(1..11,13..18,21^22): mod_base = OTHER; note = phosphorothioate linkage
gaatctacccatctgttcaatc

SEQ ID NO: 762 - DNA, 22 bp, synthetic construct
  source 1..22: mol_type = other DNA
  modified_base order(1..4,6..7,11..12,14..17,19..21): mod_base = OTHER; note = 2 prime-O-methoxyethyl nucleoside
  modified_base order(5,8..10,13,18,22): mod_base = OTHER; note = 2 prime-O-methoxyethyl-5-methylcytidine
  modified_base order(1^2,4..10,14..19,21^22): mod_base = OTHER; note = phosphorothioate linkage
gaatctacccatctgttcaatc

SEQ ID NO: 763 - DNA, 22 bp, synthetic construct
  source 1..22: mol_type = other DNA
  modified_base order(3..4,6..7,14..17,19..20): mod_base = OTHER; note = 2 prime-O-methoxyethyl nucleoside
  modified_base order(5,8..9,18): mod_base = OTHER; note = 2 prime-O-methoxyethyl-5-methylcytidine
  modified_base order(1..2,11..12,21): mod_base = OTHER; note = 2 prime-4 prime methylene bridge nucleoside
  modified_base order(10,13,22): mod_base = OTHER; note = 2 prime-4 prime methylene bridge 5-methylcytidine
  modified_base order(1^2,6..17,21^22): mod_base = OTHER; note = phosphorothioate linkage
gaatctacccatctgttcaatc

SEQ ID NO: 764 - DNA, 24 bp, synthetic construct
  source 1..24: mol_type = other DNA
  modified_base order(2..3,5,7..8,16..19,22..23): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(4,12..14,21): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 765 - DNA, 24 bp, synthetic construct
  source 1..24: mol_type = other DNA
  modified_base order(2..3,5,7..8,14,16..19,22..23): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(4,12..13,21): mod_base = OTHER; note = 2 prime-4 prime methylene bridge nucleoside
  modified_base order(1,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 766 - DNA, 24 bp, synthetic construct
  source 1..24: mol_type = other DNA
  modified_base order(3..5,7..8,14,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(2,12..13,23): mod_base = OTHER; note = 2 prime-4 prime methylene bridge nucleoside
  modified_base order(1,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 767 - DNA, 26 bp, synthetic construct
  source 1..26: mol_type = other DNA
  modified_base order(2..5,7..8,12,14,16..17,19..22,24..26): mod_base = OTHER; note = 2 prime-O-methoxyethyl nucleoside
  modified_base order(1,6,9..11,13,15,18,23): mod_base = OTHER; note = 2 prime-O-methoxyethyl-5-methylcytidine
  modified_base order(1^2,6..21,25^26): mod_base = OTHER; note = phosphorothioate linkage
cgaatctacccactcatctgttcaat

SEQ ID NO: 768 - DNA, 26 bp, synthetic construct
  source 1..26: mol_type = other DNA
  modified_base order(2..5,7..8,12,14,16..17,19..22,24..26): mod_base = OTHER; note = 2 prime-O-methoxyethyl nucleoside
  modified_base order(1,6,9..11,13,15,18,23): mod_base = OTHER; note = 2 prime-O-methoxyethyl-5-methylcytidine
  modified_base order(1^2,5..22,25^26): mod_base = OTHER; note = phosphorothioate linkage
cgaatctacccactcatctgttcaat

SEQ ID NO: 769 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1^2,6..21,25^26): mod_base = OTHER; note = phosphorothioate linkage
acgaatctacccacatctgttcaatc

SEQ ID NO: 770 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1^2,5..22,25^26): mod_base = OTHER; note = phosphorothioate linkage
acgaatctacccacatctgttcaatc

SEQ ID NO: 771 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base 1..26: mod_base = OTHER; note = phosphorothioate linkage
caaatctacccacatctgttcaatca

SEQ ID NO: 772 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base 1..26: mod_base = OTHER; note = phosphorothioate linkage
cgaatctacccacatctattcaatca

SEQ ID NO: 773 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base 1..26: mod_base = OTHER; note = phosphorothioate linkage
caaatctacccacatctattcaatca

SEQ ID NO: 774 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base 1..24: mod_base = OTHER; note = phosphorothioate linkage
cgaatctacccaatctattcaatc

SEQ ID NO: 775 - DNA, 24 bp, synthetic construct
  source 1..24: mol_type = other DNA
  modified_base order(5,7..8,15,17..20): mod_base = OTHER; note = 2 prime-O-methoxyethyl nucleoside
  modified_base order(6,9..10,16): mod_base = OTHER; note = 2 prime-O-methoxyethyl-5-methylcytidine
  modified_base order(2..4,12,14,22..24): mod_base = OTHER; note = 2 prime-4 prime methylene bridge nucleoside
  modified_base order(1,11,13,21): mod_base = OTHER; note = 2 prime-4 prime methylene bridge 5-methylcytidine
  modified_base 1..24: mod_base = OTHER; note = phosphorothioate linkage
cgaatctacccacatctgttcaat

SEQ ID NO: 776 - DNA, 24 bp, synthetic construct
  source 1..24: mol_type = other DNA
  modified_base order(5,7..8,15..16,18..20): mod_base = OTHER; note = 2 prime-O-methoxyethyl nucleoside
  modified_base order(6,9..10,17): mod_base = OTHER; note = 2 prime-O-methoxyethyl-5-methylcytidine
  modified_base order(2..4,12..13,21,23..24): mod_base = OTHER; note = 2 prime-4 prime methylene bridge nucleoside
  modified_base order(1,11,14,22): mod_base = OTHER; note = 2 prime-4 prime methylene bridge 5-methylcytidine
  modified_base 1..24: mod_base = OTHER; note = phosphorothioate linkage
cgaatctacccatcatctgttcaa

SEQ ID NO: 777 - DNA, 24 bp, synthetic construct
  source 1..24: mol_type = other DNA
  modified_base order(5..6,8..9,16..19): mod_base = OTHER; note = 2 prime-O-methoxyethyl nucleoside
  modified_base order(7,10,15,20): mod_base = OTHER; note = 2 prime-O-methoxyethyl-5-methylcytidine
  modified_base order(1,3..4,13..14,21..23): mod_base = OTHER; note = 2 prime-4 prime methylene bridge nucleoside
  modified_base order(2,11..12,24): mod_base = OTHER; note = 2 prime-4 prime methylene bridge 5-methylcytidine
  modified_base 1..24: mod_base = OTHER; note = phosphorothioate linkage
acgaatctacccatctgttcaatc

SEQ ID NO: 778 - DNA, 24 bp, synthetic construct
  source 1..24: mol_type = other DNA
  modified_base order(5..6,8..9,15,17..20): mod_base = OTHER; note = 2 prime-O-methoxyethyl nucleoside
  modified_base order(7,10,16): mod_base = OTHER; note = 2 prime-O-methoxyethyl-5-methylcytidine
  modified_base order(1,3..4,14,22..24): mod_base = OTHER; note = 2 prime-4 prime methylene bridge nucleoside
  modified_base order(2,11..13,21): mod_base = OTHER; note = 2 prime-4 prime methylene bridge 5-methylcytidine
  modified_base 1..24: mod_base = OTHER; note = phosphorothioate linkage
acgaatctaccccatctgttcaat

SEQ ID NO: 779 - DNA, 24 bp, synthetic construct
  source 1..24: mol_type = other DNA
  modified_base order(5..7,9..10,15,18..20): mod_base = OTHER; note = 2 prime-O-methoxyethyl nucleoside
  modified_base order(8,16..17): mod_base = OTHER; note = 2 prime-O-methoxyethyl-5-methylcytidine
  modified_base order(2,4,14,21..22,24): mod_base = OTHER; note = 2 prime-4 prime methylene bridge nucleoside
  modified_base order(1,3,11..13,23): mod_base = OTHER; note = 2 prime-4 prime methylene bridge 5-methylcytidine
  modified_base 1..24: mod_base = OTHER; note = phosphorothioate linkage
cacgaatctacccatccatgtact

SEQ ID NO: 780 - DNA, 24 bp, synthetic construct
  source 1..24: mol_type = other DNA
  modified_base order(5..7,9..10,15..16,19..20): mod_base = OTHER; note = 2 prime-O-methoxyethyl nucleoside
  modified_base order(8,17..18): mod_base = OTHER; note = 2 prime-O-methoxyethyl-5-methylcytidine
  modified_base order(2,4,21..23): mod_base = OTHER; note = 2 prime-4 prime methylene bridge nucleoside
  modified_base order(1,3,11..14,24): mod_base = OTHER; note = 2 prime-4 prime methylene bridge 5-methylcytidine
  modified_base 1..24: mod_base = OTHER; note = phosphorothioate linkage
cacgaatctaccccatccatgtac

SEQ ID NO: 781 - DNA, 24 bp, synthetic construct
  source 1..24: mol_type = other DNA
  modified_base order(5..8,10,15..20): mod_base = OTHER; note = 2 prime-O-methoxyethyl nucleoside
  modified_base 9: mod_base = OTHER; note = 2 prime-O-methoxyethyl-5-methylcytidine
  modified_base order(2..4,11,13..14,21..24): mod_base = OTHER; note = 2 prime-4 prime methylene bridge nucleoside
  modified_base order(1,12): mod_base = OTHER; note = 2 prime-4 prime methylene bridge 5-methylcytidine
  modified_base 1..24: mod_base = OTHER; note = phosphorothioate linkage
catttattcaacgggataagagtt

SEQ ID NO: 782 - DNA, 24 bp, synthetic construct
  source 1..24: mol_type = other DNA
  modified_base order(5..8,10,15..20): mod_base = OTHER; note = 2 prime-O-methoxyethyl nucleoside
  modified_base 9: mod_base = OTHER; note = 2 prime-O-methoxyethyl-5-methylcytidine
  modified_base order(2..4,11,13..14,21..24): mod_base = OTHER; note = 2 prime-4 prime methylene bridge nucleoside
  modified_base order(1,12): mod_base = OTHER; note = 2 prime-4 prime methylene bridge 5-methylcytidine
  modified_base 1..24: mod_base = OTHER; note = phosphorothioate linkage
catttattcaacggggataagagt

SEQ ID NO: 783 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,4..26): mod_base = OTHER; note = phosphorothioate linkage
cgaatctacccacatctgttcaatca

SEQ ID NO: 784 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..11,13..26): mod_base = OTHER; note = phosphorothioate linkage
cgaatctacccacatctgttcaatca

SEQ ID NO: 785 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..15,17..26): mod_base = OTHER; note = phosphorothioate linkage
cgaatctacccacatctgttcaatca

SEQ ID NO: 786 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..23,25^26): mod_base = OTHER; note = phosphorothioate linkage
cgaatctacccacatctgttcaatca

SEQ ID NO: 787 - DNA, 24 bp, synthetic construct
  source 1..24: mol_type = other DNA
  modified_base order(3..5,12..14,16,19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(2,7..8,17..18,23): mod_base = OTHER; note = 2 prime-4 prime methylene bridge nucleoside
  modified_base order(1,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 788 - DNA, 24 bp, synthetic construct
  source 1..24: mol_type = other DNA
  modified_base order(2..5,7..8,12,16..19,21): mod_base = OTHER; note = 2 prime-O-methoxyethyl nucleoside
  modified_base order(1,6,9..11,20): mod_base = OTHER; note = 2 prime-O-methoxyethyl-5-methylcytidine
  modified_base order(13..14,22..23): mod_base = OTHER; note = 2 prime-4 prime methylene bridge nucleoside
  modified_base order(15,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 789 - DNA, 24 bp, synthetic construct
  source 1..24: mol_type = other DNA
  modified_base order(4..5,7..8,13..14,16..19,21..23): mod_base = OTHER; note = 2 prime-O-methoxyethyl nucleoside
  modified_base order(6,9,15,20,24): mod_base = OTHER; note = 2 prime-O-methoxyethyl-5-methylcytidine
  modified_base order(2..3,12): mod_base = OTHER; note = 2 prime-4 prime methylene bridge nucleoside
  modified_base order(1,10..11): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 790 - DNA, 24 bp, synthetic construct
  source 1..24: mol_type = other DNA
  modified_base order(2..5,7..8,14,16..18,21..23): mod_base = OTHER; note = 2 prime-O-methoxyethyl nucleoside
  modified_base order(9..11,15,20): mod_base = OTHER; note = 2 prime-O-methoxyethyl-5-methylcytidine
  modified_base order(12..13,19): mod_base = OTHER; note = 2 prime-4 prime methylene bridge nucleoside
  modified_base order(1,6,24): mod_base = OTHER; note = 2 prime-4 prime methylene bridge 5-methylcytidine
  modified_base 1..24: mod_base = OTHER; note = phosphorothioate linkage
cgaatctacccaatctgttcaatc

SEQ ID NO: 791 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base order(1^2,4..24): mod_base = OTHER; note = phosphorothioate linkage
cgaatctacccaatctgttcaatc

SEQ ID NO: 792 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base order(1..10,12..24): mod_base = OTHER; note = phosphorothioate linkage
cgaatctacccaatctgttcaatc

SEQ ID NO: 793 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base order(1..14,16..24): mod_base = OTHER; note = phosphorothioate linkage
cgaatctacccaatctgttcaatc

SEQ ID NO: 794 - DNA, 24 bp, synthetic construct
  source 1..24: mol_type = other DNA
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge 5-methylcytidine
  modified_base order(1..21,23^24): mod_base = OTHER; note = phosphorothioate linkage
cgaatctacccaatctgttcaatc

SEQ ID NO: 795 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1^2,4..26): mod_base = OTHER; note = phosphorothioate linkage
cacgaatctacccccatccatgtact

SEQ ID NO: 796 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1..11,13..26): mod_base = OTHER; note = phosphorothioate linkage
cacgaatctacccccatccatgtact

SEQ ID NO: 797 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1..15,17..26): mod_base = OTHER; note = phosphorothioate linkage
cacgaatctacccccatccatgtact

SEQ ID NO: 798 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1..23,25^26): mod_base = OTHER; note = phosphorothioate linkage
cacgaatctacccccatccatgtact

SEQ ID NO: 799 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1^2,4..26): mod_base = OTHER; note = phosphorothioate linkage
ccatccatcatccgggataagagttc

SEQ ID NO: 800 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1..11,13..26): mod_base = OTHER; note = phosphorothioate linkage
ccatccatcatccgggataagagttc

SEQ ID NO: 801 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1..15,17..26): mod_base = OTHER; note = phosphorothioate linkage
ccatccatcatccgggataagagttc

SEQ ID NO: 802 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1..23,25^26): mod_base = OTHER; note = phosphorothioate linkage
ccatccatcatccgggataagagttc

SEQ ID NO: 803 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base order(1^2,4..26): mod_base = OTHER; note = phosphorothioate linkage
gcatttattcaacggggataagagtt

SEQ ID NO: 804 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base order(1..11,13..26): mod_base = OTHER; note = phosphorothioate linkage
gcatttattcaacggggataagagtt

SEQ ID NO: 805 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base order(1..15,17..26): mod_base = OTHER; note = phosphorothioate linkage
gcatttattcaacggggataagagtt

SEQ ID NO: 806 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base order(1..23,25^26): mod_base = OTHER; note = phosphorothioate linkage
gcatttattcaacggggataagagtt

SEQ ID NO: 807 - DNA, 20 bp, synthetic construct
  source 1..20: mol_type = other DNA
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base order(2,19): mod_base = OTHER; note = 2 prime-4 prime methylene bridge nucleoside
  modified_base order(1,20): mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 808 - DNA, 26 bp, synthetic construct
  source 1..26: mol_type = other DNA
  modified_base order(1..2,5..6,9..10,12..26): mod_base = OTHER; note = 2 prime-O-methoxyethyl nucleoside
  modified_base order(3..4,7..8,11): mod_base = OTHER; note = 2 prime-O-methoxyethyl-5-methylcytidine
  modified_base 1..26: mod_base = OTHER; note = phosphorothioate linkage
atccatccatcattggggataagagt

SEQ ID NO: 809 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base 1..26: mod_base = OTHER; note = phosphorothioate linkage
tccatccatcatcggggataagagtt

SEQ ID NO: 810 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base 1..26: mod_base = OTHER; note = phosphorothioate linkage
tccatccatcatcgggataagagttc

SEQ ID NO: 811 - DNA, 26 bp, synthetic construct
  source 1..26: mol_type = other DNA
  modified_base order(1,4..5,8..9,11..12,14..24,26): mod_base = OTHER; note = 2 prime-O-methoxyethyl nucleoside
  modified_base order(2..3,6..7,10,13,25): mod_base = OTHER; note = 2 prime-O-methoxyethyl-5-methylcytidine
  modified_base 1..26: mod_base = OTHER; note = phosphorothioate linkage
tccatccatcatcggataagagttct

SEQ ID NO: 812 - DNA, 26 bp, synthetic construct
  source 1..26: mol_type = other DNA
  modified_base order(3..4,7..8,10..11,14..23,25..26): mod_base = OTHER; note = 2 prime-O-methoxyethyl nucleoside
  modified_base order(1..2,5..6,9,12..13,24): mod_base = OTHER; note = 2 prime-O-methoxyethyl-5-methylcytidine
  modified_base 1..26: mod_base = OTHER; note = phosphorothioate linkage
ccatccatcatccgataagagttctt

SEQ ID NO: 813 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base 1..26: mod_base = OTHER; note = phosphorothioate linkage
gcatttattcaacgggataagagttc

SEQ ID NO: 814 - DNA, 26 bp, synthetic construct
  source 1..26: mol_type = other DNA
  modified_base order(1,3..9,11..12,14..24,26): mod_base = OTHER; note = 2 prime-O-methoxyethyl nucleoside
  modified_base order(2,10,13,25): mod_base = OTHER; note = 2 prime-O-methoxyethyl-5-methylcytidine
  modified_base 1..26: mod_base = OTHER; note = phosphorothioate linkage
gcatttattcaacggataagagttct

SEQ ID NO: 815 - DNA, 26 bp, synthetic construct
  source 1..26: mol_type = other DNA
  modified_base order(2..5,7..8,12,16..21,23..24,26): mod_base = OTHER; note = 2 prime-O-methoxyethyl nucleoside
  modified_base order(1,6,9..11,13..15,22,25): mod_base = OTHER; note = 2 prime-O-methoxyethyl-5-methylcytidine
  modified_base 1..26: mod_base = OTHER; note = phosphorothioate linkage
cgaatctacccacccttttatctact

SEQ ID NO: 816 - DNA, 26 bp, synthetic construct
  source 1..26: mol_type = other DNA
  modified_base order(2..5,7..8,12,15..19,21,23): mod_base = OTHER; note = 2 prime-O-methoxyethyl nucleoside
  modified_base order(1,6,9..11,13..14,20,22,24..26): mod_base = OTHER; note = 2 prime-O-methoxyethyl-5-methylcytidine
  modified_base 1..26: mod_base = OTHER; note = phosphorothioate linkage
cgaatctacccaccatgtactcaccc

SEQ ID NO: 817 - DNA, 26 bp, synthetic construct
  source 1..26: mol_type = other DNA
  modified_base order(2,4..7,9..10,16..17,20..25): mod_base = OTHER; note = 2 prime-O-methoxyethyl nucleoside
  modified_base order(1,3,8,11..15,18..19,26): mod_base = OTHER; note = 2 prime-O-methoxyethyl-5-methylcytidine
  modified_base 1..26: mod_base = OTHER; note = phosphorothioate linkage
cacgaatctacccccatccttttatc

SEQ ID NO: 818 - DNA, 26 bp, synthetic construct
  source 1..26: mol_type = other DNA
  modified_base order(2,4..7,9..10,15..18,20..22,24..26): mod_base = OTHER; note = 2 prime-O-methoxyethyl nucleoside
  modified_base order(1,3,8,11..14,19,23): mod_base = OTHER; note = 2 prime-O-methoxyethyl-5-methylcytidine
  modified_base 1..26: mod_base = OTHER; note = phosphorothioate linkage
cacgaatctacccctgttcaatcatt

SEQ ID NO: 819 - DNA, 26 bp, synthetic construct
  source 1..26: mol_type = other DNA
  modified_base order(2,4..7,9..10,14..16,18..20,22..24,26): mod_base = OTHER; note = 2 prime-O-methoxyethyl nucleoside
  modified_base order(1,3,8,11..13,17,21,25): mod_base = OTHER; note = 2 prime-O-methoxyethyl-5-methylcytidine
  modified_base 1..26: mod_base = OTHER; note = phosphorothioate linkage
cacgaatctacccgttcaatcattca

SEQ ID NO: 820 - DNA, 26 bp, synthetic construct
  source 1..26: mol_type = other DNA
  modified_base order(2..5,7..8,12,14,17..22,24..25): mod_base = OTHER; note = 2 prime-O-methoxyethyl nucleoside
  modified_base order(1,6,9..11,13,15..16,23,26): mod_base = OTHER; note = 2 prime-O-methoxyethyl-5-methylcytidine
  modified_base 1..26: mod_base = OTHER; note = phosphorothioate linkage
cgaatctacccactccttttatctac

SEQ ID NO: 821 - DNA, 26 bp, synthetic construct
  source 1..26: mol_type = other DNA
  modified_base order(2..5,7..8,12,15..18,20..22,24..26): mod_base = OTHER; note = 2 prime-O-methoxyethyl nucleoside
  modified_base order(1,6,9..11,13..14,19,23): mod_base = OTHER; note = 2 prime-O-methoxyethyl-5-methylcytidine
  modified_base 1..26: mod_base = OTHER; note = phosphorothioate linkage
cgaatctacccacctgttcaatcatt

SEQ ID NO: 822 - DNA, 26 bp, synthetic construct
  source 1..26: mol_type = other DNA
  modified_base order(2..5,7..8,12,15..20,22..23,25): mod_base = OTHER; note = 2 prime-O-methoxyethyl nucleoside
  modified_base order(1,6,9..11,13..14,21,24,26): mod_base = OTHER; note = 2 prime-O-methoxyethyl-5-methylcytidine
  modified_base 1..26: mod_base = OTHER; note = phosphorothioate linkage
cgaatctacccaccttttatctactc

SEQ ID NO: 823 - DNA, 26 bp, synthetic construct
  source 1..26: mol_type = other DNA
  modified_base order(2..5,7..8,12,14..16,18..20,22..24,26): mod_base = OTHER; note = 2 prime-O-methoxyethyl nucleoside
  modified_base order(1,6,9..11,13,17,21,25): mod_base = OTHER; note = 2 prime-O-methoxyethyl-5-methylcytidine
  modified_base 1..26: mod_base = OTHER; note = phosphorothioate linkage
cgaatctacccacgttcaatcattca

SEQ ID NO: 824 - DNA, 26 bp, synthetic construct
  source 1..26: mol_type = other DNA
  modified_base order(1,3..6,8..9,13..16,18,20,24..25): mod_base = OTHER; note = 2 prime-O-methoxyethyl nucleoside
  modified_base order(2,7,10..12,17,19,21..23,26): mod_base = OTHER; note = 2 prime-O-methoxyethyl-5-methylcytidine
  modified_base 1..26: mod_base = OTHER; note = phosphorothioate linkage
acgaatctacccagtactcacccatc

SEQ ID NO: 825 - DNA, 26 bp, synthetic construct
  source 1..26: mol_type = other DNA
  modified_base order(2..5,7..8,12,14..17,19..21,23..25): mod_base = OTHER; note = 2 prime-O-methoxyethyl nucleoside
  modified_base order(1,6,9..11,13,18,22,26): mod_base = OTHER; note = 2 prime-O-methoxyethyl-5-methylcytidine
  modified_base 1..26: mod_base = OTHER; note = phosphorothioate linkage
cgaatctacccactgttcaatcattc

SEQ ID NO: 826 - DNA, 26 bp, synthetic construct
  source 1..26: mol_type = other DNA
  modified_base order(2,4..7,9..10,15..16,18..21,23..25): mod_base = OTHER; note = 2 prime-O-methoxyethyl nucleoside
  modified_base order(1,3,8,11..14,17,22,26): mod_base = OTHER; note = 2 prime-O-methoxyethyl-5-methylcytidine
  modified_base 1..26: mod_base = OTHER; note = phosphorothioate linkage
cacgaatctaccccatctgttcaatc

SEQ ID NO: 827 - DNA, 26 bp, synthetic construct
  source 1..26: mol_type = other DNA
  modified_base order(2,4..7,9..10,16..21,23..24,26): mod_base = OTHER; note = 2 prime-O-methoxyethyl nucleoside
  modified_base order(1,3,8,11..15,22,25): mod_base = OTHER; note = 2 prime-O-methoxyethyl-5-methylcytidine
  modified_base 1..26: mod_base = OTHER; note = phosphorothioate linkage
cacgaatctacccccttttatctact

SEQ ID NO: 828 - DNA, 26 bp, synthetic construct
  source 1..26: mol_type = other DNA
  modified_base order(2,4..7,9..10,16..20,22,24): mod_base = OTHER; note = 2 prime-O-methoxyethyl nucleoside
  modified_base order(1,3,8,11..15,21,23,25..26): mod_base = OTHER; note = 2 prime-O-methoxyethyl-5-methylcytidine
  modified_base 1..26: mod_base = OTHER; note = phosphorothioate linkage
cacgaatctacccccatgtactcacc

SEQ ID NO: 829 - DNA, 26 bp, synthetic construct
  source 1..26: mol_type = other DNA
  modified_base order(2..5,7..8,12,14..16,18,21..22,24..26): mod_base = OTHER; note = 2 prime-O-methoxyethyl nucleoside
  modified_base order(1,6,9..11,13,17,19..20,23): mod_base = OTHER; note = 2 prime-O-methoxyethyl-5-methylcytidine
  modified_base 1..26: mod_base = OTHER; note = phosphorothioate linkage
cgaatctacccacattcaccagcatt

SEQ ID NO: 830 - DNA, 26 bp, synthetic construct
  source 1..26: mol_type = other DNA
  modified_base order(2..5,7..8,12,15..16,18..21,23..25): mod_base = OTHER; note = 2 prime-O-methoxyethyl nucleoside
  modified_base order(1,6,9..11,13..14,17,22,26): mod_base = OTHER; note = 2 prime-O-methoxyethyl-5-methylcytidine
  modified_base 1..26: mod_base = OTHER; note = phosphorothioate linkage
cgaatctacccaccatctgttcaatc

SEQ ID NO: 831 - DNA, 26 bp, synthetic construct
  source 1..26: mol_type = other DNA
  modified_base order(1,3..6,8..9,13,16..17,20..25): mod_base = OTHER; note = 2 prime-O-methoxyethyl nucleoside
  modified_base order(2,7,10..12,14..15,18..19,26): mod_base = OTHER; note = 2 prime-O-methoxyethyl-5-methylcytidine
  modified_base 1..26: mod_base = OTHER; note = phosphorothioate linkage
acgaatctacccaccatccttttatc

SEQ ID NO: 832 - DNA, 26 bp, synthetic construct
  source 1..26: mol_type = other DNA
  modified_base order(2..5,7..8,12,14..16,18,20,24..25): mod_base = OTHER; note = 2 prime-O-methoxyethyl nucleoside
  modified_base order(1,6,9..11,13,17,19,21..23,26): mod_base = OTHER; note = 2 prime-O-methoxyethyl-5-methylcytidine
  modified_base 1..26: mod_base = OTHER; note = phosphorothioate linkage
cgaatctacccacgtactcacccatc

SEQ ID NO: 833 - DNA, 26 bp, synthetic construct
  source 1..26: mol_type = other DNA
  modified_base order(2,4..7,9..10,14..16,18,20,24..25): mod_base = OTHER; note = 2 prime-O-methoxyethyl nucleoside
  modified_base order(1,3,8,11..13,17,19,21..23,26): mod_base = OTHER; note = 2 prime-O-methoxyethyl-5-methylcytidine
  modified_base 1..26: mod_base = OTHER; note = phosphorothioate linkage
cacgaatctacccgtactcacccatc

SEQ ID NO: 834 - DNA, 26 bp, synthetic construct
  source 1..26: mol_type = other DNA
  modified_base order(1,3..6,8..9,13..16,18,21..22,24..26): mod_base = OTHER; note = 2 prime-O-methoxyethyl nucleoside
  modified_base order(2,7,10..12,17,19..20,23): mod_base = OTHER; note = 2 prime-O-methoxyethyl-5-methylcytidine
  modified_base 1..26: mod_base = OTHER; note = phosphorothioate linkage
acgaatctacccaattcaccagcatt

SEQ ID NO: 835 - DNA, 26 bp, synthetic construct
  source 1..26: mol_type = other DNA
  modified_base order(2..5,7..8,12,14..17,21..23,25..26): mod_base = OTHER; note = 2 prime-O-methoxyethyl nucleoside
  modified_base order(1,6,9..11,13,18..20,24): mod_base = OTHER; note = 2 prime-O-methoxyethyl-5-methylcytidine
  modified_base 1..26: mod_base = OTHER; note = phosphorothioate linkage
cgaatctacccacgaaacccaggcag

SEQ ID NO: 836 - DNA, 26 bp, synthetic construct
  source 1..26: mol_type = other DNA
  modified_base order(3,5..8,10..11,14..18,22..24,26): mod_base = OTHER; note = 2 prime-O-methoxyethyl nucleoside
  modified_base order(1..2,4,9,12..13,19..21,25): mod_base = OTHER; note = 2 prime-O-methoxyethyl-5-methylcytidine
  modified_base 1..26: mod_base = OTHER; note = phosphorothioate linkage
ccacgaatctaccggaaacccaggca

SEQ ID NO: 837 - DNA, 26 bp, synthetic construct
  source 1..26: mol_type = other DNA
  modified_base order(2..4,6..11,14..18,22..24,26): mod_base = OTHER; note = 2 prime-O-methoxyethyl nucleoside
  modified_base order(1,5,12..13,19..21,25): mod_base = OTHER; note = 2 prime-O-methoxyethyl-5-methylcytidine
  modified_base 1..26: mod_base = OTHER; note = phosphorothioate linkage
caatcatatatccggaaacccaggca

SEQ ID NO: 838 - DNA, 26 bp, synthetic construct
  source 1..26: mol_type = other DNA
  modified_base order(2..8,10..12,14..18,22..24,26): mod_base = OTHER; note = 2 prime-O-methoxyethyl nucleoside
  modified_base order(1,9,13,19..21,25): mod_base = OTHER; note = 2 prime-O-methoxyethyl-5-methylcytidine
  modified_base 1..26: mod_base = OTHER; note = phosphorothioate linkage
caatagttcaatcggaaacccaggca

SEQ ID NO: 839 - DNA, 26 bp, synthetic construct
  source 1..26: mol_type = other DNA
  modified_base order(1,3..5,8,10..15,18..23): mod_base = OTHER; note = 2 prime-O-methoxyethyl nucleoside
  modified_base order(2,6..7,9,16..17,24..26): mod_base = OTHER; note = 2 prime-O-methoxyethyl-5-methylcytidine
  modified_base 1..26: mod_base = OTHER; note = phosphorothioate linkage
tctagccacgaatttccaggaaaccc

SEQ ID NO: 840 - DNA, 26 bp, synthetic construct
  source 1..26: mol_type = other DNA
  modified_base order(1..3,5,7,11..12,14..23,25..26): mod_base = OTHER; note = 2 prime-O-methoxyethyl nucleoside
  modified_base order(4,6,8..10,13,24): mod_base = OTHER; note = 2 prime-O-methoxyethyl-5-methylcytidine
  modified_base 1..26: mod_base = OTHER; note = phosphorothioate linkage
gtactcacccatcgataagagttctt

SEQ ID NO: 841 - DNA, 26 bp, synthetic construct
  source 1..26: mol_type = other DNA
  modified_base order(3..7,9,11,14..24,26): mod_base = OTHER; note = 2 prime-O-methoxyethyl nucleoside
  modified_base order(1..2,8,10,12..13,25): mod_base = OTHER; note = 2 prime-O-methoxyethyl-5-methylcytidine
  modified_base 1..26: mod_base = OTHER; note = phosphorothioate linkage
ccatgtactcaccggataagagttct

SEQ ID NO: 842 - DNA, 26 bp, synthetic construct
  source 1..26: mol_type = other DNA
  modified_base order(1..3,6..7,10..11,14..24,26): mod_base = OTHER; note = 2 prime-O-methoxyethyl nucleoside
  modified_base order(4..5,8..9,12..13,25): mod_base = OTHER; note = 2 prime-O-methoxyethyl-5-methylcytidine
  modified_base 1..26: mod_base = OTHER; note = phosphorothioate linkage
tgtccatccatccggataagagttct

SEQ ID NO: 843 - DNA, 26 bp, synthetic construct
  source 1..26: mol_type = other DNA
  modified_base order(1..2,4..6,8,11..12,14..25): mod_base = OTHER; note = 2 prime-O-methoxyethyl nucleoside
  modified_base order(3,7,9..10,13,26): mod_base = OTHER; note = 2 prime-O-methoxyethyl-5-methylcytidine
  modified_base 1..26: mod_base = OTHER; note = phosphorothioate linkage
ttcattcaccagcgggataagagttc

SEQ ID NO: 844 - DNA, 26 bp, synthetic construct
  source 1..26: mol_type = other DNA
  modified_base order(2..3,5,7..8,10,12,14..25): mod_base = OTHER; note = 2 prime-O-methoxyethyl nucleoside
  modified_base order(1,4,6,9,11,13,26): mod_base = OTHER; note = 2 prime-O-methoxyethyl-5-methylcytidine
  modified_base 1..26: mod_base = OTHER; note = phosphorothioate linkage
ctactcatcactcgggataagagttc

SEQ ID NO: 845 - DNA, 26 bp, synthetic construct
  source 1..26: mol_type = other DNA
  modified_base order(1,3,6..7,10..11,14..25): mod_base = OTHER; note = 2 prime-O-methoxyethyl nucleoside
  modified_base order(2,4..5,8..9,12..13,26): mod_base = OTHER; note = 2 prime-O-methoxyethyl-5-methylcytidine
  modified_base 1..26: mod_base = OTHER; note = phosphorothioate linkage
tctccatccatccgggataagagttc

SEQ ID NO: 846 - DNA, 26 bp, synthetic construct
  source 1..26: mol_type = other DNA
  modified_base order(1..3,5,7,11..12,14..25): mod_base = OTHER; note = 2 prime-O-methoxyethyl nucleoside
  modified_base order(4,6,8..10,13,26): mod_base = OTHER; note = 2 prime-O-methoxyethyl-5-methylcytidine
  modified_base 1..26: mod_base = OTHER; note = phosphorothioate linkage
gtactcacccatcgggataagagttc

SEQ ID NO: 847 - DNA, 26 bp, synthetic construct
  source 1..26: mol_type = other DNA
  modified_base order(2..6,8,10,14..25): mod_base = OTHER; note = 2 prime-O-methoxyethyl nucleoside
  modified_base order(1,7,9,11..13,26): mod_base = OTHER; note = 2 prime-O-methoxyethyl-5-methylcytidine
  modified_base 1..26: mod_base = OTHER; note = phosphorothioate linkage
catgtactcacccgggataagagttc

SEQ ID NO: 848 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base 1..26: mod_base = OTHER; note = phosphorothioate linkage
catccatctatccgggataagagttc

SEQ ID NO: 849 - DNA, 26 bp, synthetic construct
  source 1..26: mol_type = other DNA
  modified_base order(3..4,7..8,10..12,14..25): mod_base = OTHER; note = 2 prime-O-methoxyethyl nucleoside
  modified_base order(1..2,5..6,9,13,26): mod_base = OTHER; note = 2 prime-O-methoxyethyl-5-methylcytidine
  modified_base 1..26: mod_base = OTHER; note = phosphorothioate linkage
ccatccatctgtcgggataagagttc

SEQ ID NO: 850 - DNA, 26 bp, synthetic construct
  source 1..26: mol_type = other DNA
  modified_base order(3..4,6..12,14..26): mod_base = OTHER; note = 2 prime-O-methoxyethyl nucleoside
  modified_base order(1..2,5,13): mod_base = OTHER; note = 2 prime-O-methoxyethyl-5-methylcytidine
  modified_base 1..26: mod_base = OTHER; note = phosphorothioate linkage
ccagcatttattcggggataagagtt

SEQ ID NO: 851 - DNA, 26 bp, synthetic construct
  source 1..26: mol_type = other DNA
  modified_base order(1..2,4..6,8,11..12,14..26): mod_base = OTHER; note = 2 prime-O-methoxyethyl nucleoside
  modified_base order(3,7,9..10,13): mod_base = OTHER; note = 2 prime-O-methoxyethyl-5-methylcytidine
  modified_base 1..26: mod_base = OTHER; note = phosphorothioate linkage
ttcattcaccagcggggataagagtt

SEQ ID NO: 852 - DNA, 26 bp, synthetic construct
  source 1..26: mol_type = other DNA
  modified_base order(1..4,6..8,10..12,14..26): mod_base = OTHER; note = 2 prime-O-methoxyethyl nucleoside
  modified_base order(5,9,13): mod_base = OTHER; note = 2 prime-O-methoxyethyl-5-methylcytidine
  modified_base 1..26: mod_base = OTHER; note = phosphorothioate linkage
tgttcaatcattcggggataagagtt

SEQ ID NO: 853 - DNA, 26 bp, synthetic construct
  source 1..26: mol_type = other DNA
  modified_base order(1..4,6..7,9,11..12,14..26): mod_base = OTHER; note = 2 prime-O-methoxyethyl nucleoside
  modified_base order(5,8,10,13): mod_base = OTHER; note = 2 prime-O-methoxyethyl-5-methylcytidine
  modified_base 1..26: mod_base = OTHER; note = phosphorothioate linkage
ttatctactcatcggggataagagtt

SEQ ID NO: 854 - DNA, 26 bp, synthetic construct
  source 1..26: mol_type = other DNA
  modified_base order(2,6..7,9,11,14..26): mod_base = OTHER; note = 2 prime-O-methoxyethyl nucleoside
  modified_base order(1,3..5,8,10,12..13): mod_base = OTHER; note = 2 prime-O-methoxyethyl-5-methylcytidine
  modified_base 1..26: mod_base = OTHER; note = phosphorothioate linkage
cacccatctctccggggataagagtt

SEQ ID NO: 855 - DNA, 26 bp, synthetic construct
  source 1..26: mol_type = other DNA
  modified_base order(1..3,5,7,11..12,14..26): mod_base = OTHER; note = 2 prime-O-methoxyethyl nucleoside
  modified_base order(4,6,8..10,13): mod_base = OTHER; note = 2 prime-O-methoxyethyl-5-methylcytidine
  modified_base 1..26: mod_base = OTHER; note = phosphorothioate linkage
gtactcacccatcggggataagagtt

SEQ ID NO: 856 - DNA, 26 bp, synthetic construct
  source 1..26: mol_type = other DNA
  modified_base order(2..6,8,10,14..26): mod_base = OTHER; note = 2 prime-O-methoxyethyl nucleoside
  modified_base order(1,7,9,11..13): mod_base = OTHER; note = 2 prime-O-methoxyethyl-5-methylcytidine
  modified_base 1..26: mod_base = OTHER; note = phosphorothioate linkage
catgtactcacccggggataagagtt

SEQ ID NO: 857 - DNA, 26 bp, synthetic construct
  source 1..26: mol_type = other DNA
  modified_base order(3..4,6..8,11..12,14..26): mod_base = OTHER; note = 2 prime-O-methoxyethyl nucleoside
  modified_base order(1..2,5,9..10,13): mod_base = OTHER; note = 2 prime-O-methoxyethyl-5-methylcytidine
  modified_base 1..26: mod_base = OTHER; note = phosphorothioate linkage
ccatctatccatcggggataagagtt

SEQ ID NO: 858 - DNA, 26 bp, synthetic construct
  source 1..26: mol_type = other DNA
  modified_base order(2..3,6..7,9..11,14..26): mod_base = OTHER; note = 2 prime-O-methoxyethyl nucleoside
  modified_base order(1,4..5,8,12..13): mod_base = OTHER; note = 2 prime-O-methoxyethyl-5-methylcytidine
  modified_base 1..26: mod_base = OTHER; note = phosphorothioate linkage
catccatctagccggggataagagtt

SEQ ID NO: 859 - DNA, 26 bp, synthetic construct
  source 1..26: mol_type = other DNA
  modified_base order(2..4,7..8,11..12,14..26): mod_base = OTHER; note = 2 prime-O-methoxyethyl nucleoside
  modified_base order(1,5..6,9..10,13): mod_base = OTHER; note = 2 prime-O-methoxyethyl-5-methylcytidine
  modified_base 1..26: mod_base = OTHER; note = phosphorothioate linkage
ctgtccatccatcggggataagagtt

SEQ ID NO: 860 - DNA, 26 bp, synthetic construct
  source 1..26: mol_type = other DNA
  modified_base order(2..4,6..11,14..26): mod_base = OTHER; note = 2 prime-O-methoxyethyl nucleoside
  modified_base order(1,5,12..13): mod_base = OTHER; note = 2 prime-O-methoxyethyl-5-methylcytidine
  modified_base 1..26: mod_base = OTHER; note = phosphorothioate linkage
caatcatatatccggggataagagtt

SEQ ID NO: 861 - DNA, 26 bp, synthetic construct
  source 1..26: mol_type = other DNA
  modified_base order(3..4,6..8,11,13..15,18..26): mod_base = OTHER; note = 2 prime-O-methoxyethyl nucleoside
  modified_base order(1..2,5,9..10,12,16..17): mod_base = OTHER; note = 2 prime-O-methoxyethyl-5-methylcytidine
  modified_base 1..26: mod_base = OTHER; note = phosphorothioate linkage
ccatctagccacgttcctggggataa

SEQ ID NO: 862 - DNA, 26 bp, synthetic construct
  source 1..26: mol_type = other DNA
  modified_base order(2..6,8,10,14..16,19..26): mod_base = OTHER; note = 2 prime-O-methoxyethyl nucleoside
  modified_base order(1,7,9,11..13,17..18): mod_base = OTHER; note = 2 prime-O-methoxyethyl-5-methylcytidine
  modified_base 1..26: mod_base = OTHER; note = phosphorothioate linkage
catgtactcacccgttcctggggata

SEQ ID NO: 863 - DNA, 26 bp, synthetic construct
  source 1..26: mol_type = other DNA
  modified_base order(2..4,7,9..12,14,16..20,23..26): mod_base = OTHER; note = 2 prime-O-methoxyethyl nucleoside
  modified_base order(1,5..6,8,13,15,21..22): mod_base = OTHER; note = 2 prime-O-methoxyethyl-5-methylcytidine
  modified_base 1..26: mod_base = OTHER; note = phosphorothioate linkage
ctagccacgaatcactagttcctggg

SEQ ID NO: 864 - DNA, 26 bp, synthetic construct
  source 1..26: mol_type = other DNA
  modified_base order(3,5..8,10..11,14,16..22,24..25): mod_base = OTHER; note = 2 prime-O-methoxyethyl nucleoside
  modified_base order(1..2,4,9,12..13,15,23,26): mod_base = OTHER; note = 2 prime-O-methoxyethyl-5-methylcytidine
  modified_base 1..26: mod_base = OTHER; note = phosphorothioate linkage
ccacgaatctaccgcatttattcaac

SEQ ID NO: 865 - DNA, 26 bp, synthetic construct
  source 1..26: mol_type = other DNA
  modified_base order(2..4,7,9..12,14..16,18,20,24..25): mod_base = OTHER; note = 2 prime-O-methoxyethyl nucleoside
  modified_base order(1,5..6,8,13,17,19,21..23,26): mod_base = OTHER; note = 2 prime-O-methoxyethyl-5-methylcytidine
  modified_base 1..26: mod_base = OTHER; note = phosphorothioate linkage
ctagccacgaatcgtactcacccatc

SEQ ID NO: 866 - DNA, 24 bp, synthetic construct
  source 1..24: mol_type = other DNA
  modified_base order(1..4,6..7,11,13..14,16,19..20,22..24): mod_base = OTHER; note = 2 prime-O-methoxyethyl nucleoside
  modified_base order(5,8..10,12,15,17..18,21): mod_base = OTHER; note = 2 prime-O-methoxyethyl-5-methylcytidine
  modified_base 1..24: mod_base = OTHER; note = phosphorothioate linkage
gaatctacccacttcaccagcatt

SEQ ID NO: 867 - DNA, 24 bp, synthetic construct
  source 1..24: mol_type = other DNA
  modified_base order(2..5,7..8,12..14,16,19..20,22..24): mod_base = OTHER; note = 2 prime-O-methoxyethyl nucleoside
  modified_base order(1,6,9..11,15,17..18,21): mod_base = OTHER; note = 2 prime-O-methoxyethyl-5-methylcytidine
  modified_base 1..24: mod_base = OTHER; note = phosphorothioate linkage
cgaatctacccattcaccagcatt

SEQ ID NO: 868 - DNA, 24 bp, synthetic construct
  source 1..24: mol_type = other DNA
  modified_base order(1..4,6..7,11,13..15,17,20..21,23..24): mod_base = OTHER; note = 2 prime-O-methoxyethyl nucleoside
  modified_base order(5,8..10,12,16,18..19,22): mod_base = OTHER; note = 2 prime-O-methoxyethyl-5-methylcytidine
  modified_base 1..24: mod_base = OTHER; note = phosphorothioate linkage
gaatctacccacattcaccagcat

SEQ ID NO: 869 - DNA, 24 bp, synthetic construct
  source 1..24: mol_type = other DNA
  modified_base order(2..5,7..8,12..15,17,20..21,23..24): mod_base = OTHER; note = 2 prime-O-methoxyethyl nucleoside
  modified_base order(1,6,9..11,16,18..19,22): mod_base = OTHER; note = 2 prime-O-methoxyethyl-5-methylcytidine
  modified_base 1..24: mod_base = OTHER; note = phosphorothioate linkage
cgaatctacccaattcaccagcat

SEQ ID NO: 870 - DNA, 24 bp, synthetic construct
  source 1..24: mol_type = other DNA
  modified_base order(1..3,6..7,11,13..14,19,22..23): mod_base = OTHER; note = 2 prime-O-methoxyethyl nucleoside
  modified_base order(5,9..10,15,17..18,21): mod_base = OTHER; note = 2 prime-O-methoxyethyl-5-methylcytidine
  modified_base order(4,16,20,24): mod_base = OTHER; note = 2 prime-4 prime methylene bridge nucleoside
  modified_base order(8,12): mod_base = OTHER; note = 2 prime-4 prime methylene bridge 5-methylcytidine
  modified_base 1..24: mod_base = OTHER; note = phosphorothioate linkage
gaatctacccacttcaccagcatt

SEQ ID NO: 871 - DNA, 24 bp, synthetic construct
  source 1..24: mol_type = other DNA
  modified_base order(2..3,5,7,13..14,19,22..23): mod_base = OTHER; note = 2 prime-O-methoxyethyl nucleoside
  modified_base order(1,6,9..11,15,17..18,21): mod_base = OTHER; note = 2 prime-O-methoxyethyl-5-methylcytidine
  modified_base order(4,8,12,16,20,24): mod_base = OTHER; note = 2 prime-4 prime methylene bridge nucleoside
  modified_base 1..24: mod_base = OTHER; note = phosphorothioate linkage
cgaatctacccattcaccagcatt

SEQ ID NO: 872 - DNA, 24 bp, synthetic construct
  source 1..24: mol_type = other DNA
  modified_base order(1..3,6..7,11,13..15,17,21,23): mod_base = OTHER; note = 2 prime-O-methoxyethyl nucleoside
  modified_base order(5,9..10,18..19,22): mod_base = OTHER; note = 2 prime-O-methoxyethyl-5-methylcytidine
  modified_base order(4,20,24): mod_base = OTHER; note = 2 prime-4 prime methylene bridge nucleoside
  modified_base order(8,12,16): mod_base = OTHER; note = 2 prime-4 prime methylene bridge 5-methylcytidine
  modified_base 1..24: mod_base = OTHER; note = phosphorothioate linkage
gaatctacccacattcaccagcat

SEQ ID NO: 873 - DNA, 24 bp, synthetic construct
  source 1..24: mol_type = other DNA
  modified_base order(2..3,5,7,13..15,17,21,23): mod_base = OTHER; note = 2 prime-O-methoxyethyl nucleoside
  modified_base order(1,6,9..11,18..19,22): mod_base = OTHER; note = 2 prime-O-methoxyethyl-5-methylcytidine
  modified_base order(4,8,12,20,24): mod_base = OTHER; note = 2 prime-4 prime methylene bridge nucleoside
  modified_base 16: mod_base = OTHER; note = 2 prime-4 prime methylene bridge 5-methylcytidine
  modified_base 1..24: mod_base = OTHER; note = phosphorothioate linkage
cgaatctacccaattcaccagcat

SEQ ID NO: 874 - DNA, 26 bp, synthetic construct
  source 1..26: mol_type = other DNA
  modified_base order(2..5,7..8,18,21..22,24..26): mod_base = OTHER; note = 2 prime-O-methoxyethyl nucleoside
  modified_base order(1,6,9..10,17,19..20,23): mod_base = OTHER; note = 2 prime-O-methoxyethyl-5-methylcytidine
  modified_base order(12,14..16): mod_base = OTHER; note = 2 prime-4 prime methylene bridge nucleoside
  modified_base order(11,13): mod_base = OTHER; note = 2 prime-4 prime methylene bridge 5-methylcytidine
  modified_base 1..26: mod_base = OTHER; note = phosphorothioate linkage
cgaatctacccacattcaccagcatt

SEQ ID NO: 875 - DNA, 26 bp, synthetic construct
  source 1..26: mol_type = other DNA
  modified_base order(5,7..8,12,14..16,18,21..22): mod_base = OTHER; note = 2 prime-O-methoxyethyl nucleoside
  modified_base order(6,9..11,13,17,19..20): mod_base = OTHER; note = 2 prime-O-methoxyethyl-5-methylcytidine
  modified_base order(2..4,24..26): mod_base = OTHER; note = 2 prime-4 prime methylene bridge nucleoside
  modified_base order(1,23): mod_base = OTHER; note = 2 prime-4 prime methylene bridge 5-methylcytidine
  modified_base 1..26: mod_base = OTHER; note = phosphorothioate linkage
cgaatctacccacattcaccagcatt

SEQ ID NO: 876 - DNA, 26 bp, synthetic construct
  source 1..26: mol_type = other DNA
  modified_base order(5,7..8,16,18,21..22): mod_base = OTHER; note = 2 prime-O-methoxyethyl nucleoside
  modified_base order(6,9..11,17,19..20): mod_base = OTHER; note = 2 prime-O-methoxyethyl-5-methylcytidine
  modified_base order(2..4,12,14..15,24..26): mod_base = OTHER; note = 2 prime-4 prime methylene bridge nucleoside
  modified_base order(1,13,23): mod_base = OTHER; note = 2 prime-4 prime methylene bridge 5-methylcytidine
  modified_base 1..26: mod_base = OTHER; note = phosphorothioate linkage
cgaatctacccacattcaccagcatt

SEQ ID NO: 877 - DNA, 25 bp, synthetic construct
  source 1..25: mol_type = other DNA
  modified_base order(1..4,6..7,11,13..15,17,20..21,23..25): mod_base = OTHER; note = 2 prime-O-methoxyethyl nucleoside
  modified_base order(5,8..10,12,16,18..19,22): mod_base = OTHER; note = 2 prime-O-methoxyethyl-5-methylcytidine
  modified_base 1..25: mod_base = OTHER; note = phosphorothioate linkage
gaatctacccacattcaccagcatt

SEQ ID NO: 878 - DNA, 25 bp, synthetic construct
  source 1..25: mol_type = other DNA
  modified_base order(2..5,7..8,12,14..16,18,21..22,24..25): mod_base = OTHER; note = 2 prime-O-methoxyethyl nucleoside
  modified_base order(1,6,9..11,13,17,19..20,23): mod_base = OTHER; note = 2 prime-O-methoxyethyl-5-methylcytidine
  modified_base 1..25: mod_base = OTHER; note = phosphorothioate linkage
cgaatctacccacattcaccagcat

SEQ ID NO: 879 - DNA, 24 bp, synthetic construct
  source 1..24: mol_type = other DNA
  modified_base order(2..5,7..8,16,19..20,22..24): mod_base = OTHER; note = 2 prime-O-methoxyethyl nucleoside
  modified_base order(1,6,9,17..18,21): mod_base = OTHER; note = 2 prime-O-methoxyethyl-5-methylcytidine
  modified_base 12..14: mod_base = OTHER; note = 2 prime-4 prime methylene bridge nucleoside
  modified_base order(10..11,15): mod_base = OTHER; note = 2 prime-4 prime methylene bridge 5-methylcytidine
  modified_base 1..24: mod_base = OTHER; note = phosphorothioate linkage
cgaatctacccattcaccagcatt

SEQ ID NO: 880 - DNA, 24 bp, synthetic construct
  source 1..24: mol_type = other DNA
  modified_base order(5,7..8,16,19..20): mod_base = OTHER; note = 2 prime-O-methoxyethyl nucleoside
  modified_base order(6,9..10,15,17..18): mod_base = OTHER; note = 2 prime-O-methoxyethyl-5-methylcytidine
  modified_base order(2..4,12..14,22..24): mod_base = OTHER; note = 2 prime-4 prime methylene bridge nucleoside
  modified_base order(1,11,21): mod_base = OTHER; note = 2 prime-4 prime methylene bridge 5-methylcytidine
  modified_base 1..24: mod_base = OTHER; note = phosphorothioate linkage
cgaatctacccattcaccagcatt

SEQ ID NO: 881 - DNA, 20 bp, synthetic construct
  source 1..20: mol_type = other DNA
  modified_base order(2..7,10..11,13..15,18,20): mod_base = OTHER; note = 2 prime-O-methoxyethyl nucleoside
  modified_base order(1,8..9,12,16..17,19): mod_base = OTHER; note = 2 prime-O-methoxyethyl-5-methylcytidine
  modified_base 1..20: mod_base = OTHER; note = phosphorothioate linkage
catatatccatctagccacg

SEQ ID NO: 882 - DNA, 20 bp, synthetic construct
  source 1..20: mol_type = other DNA
  modified_base order(1,3..6,8..9,13..14,17..20): mod_base = OTHER; note = 2 prime-O-methoxyethyl nucleoside
  modified_base order(2,7,10..12,15..16): mod_base = OTHER; note = 2 prime-O-methoxyethyl-5-methylcytidine
  modified_base 1..20: mod_base = OTHER; note = phosphorothioate linkage
acgaatctacccatccatgt

SEQ ID NO: 883 - DNA, 20 bp, synthetic construct
  source 1..20: mol_type = other DNA
  modified_base order(1..3,6..7,10,12..15,17..18): mod_base = OTHER; note = 2 prime-O-methoxyethyl nucleoside
  modified_base order(4..5,8..9,11,16,19..20): mod_base = OTHER; note = 2 prime-O-methoxyethyl-5-methylcytidine
  modified_base 1..20: mod_base = OTHER; note = phosphorothioate linkage
tgtccatccacgaatctacc

SEQ ID NO: 884 - DNA, 20 bp, synthetic construct
  source 1..20: mol_type = other DNA
  modified_base order(2..5,7..8,11..12,14,16..17,20): mod_base = OTHER; note = 2 prime-O-methoxyethyl nucleoside
  modified_base order(1,6,9..10,13,15,18..19): mod_base = OTHER; note = 2 prime-O-methoxyethyl-5-methylcytidine
  modified_base 1..20: mod_base = OTHER; note = phosphorothioate linkage
cgaatctaccaactcatcca

SEQ ID NO: 885 - DNA, 20 bp, synthetic construct
  source 1..20: mol_type = other DNA
  modified_base order(1,3..6,8..9,12..13,16..20): mod_base = OTHER; note = 2 prime-O-methoxyethyl nucleoside
  modified_base order(2,7,10..11,14..15): mod_base = OTHER; note = 2 prime-O-methoxyethyl-5-methylcytidine
  modified_base 1..20: mod_base = OTHER; note = phosphorothioate linkage
acgaatctaccatccatgta

SEQ ID NO: 886 - DNA, 20 bp, synthetic construct
  source 1..20: mol_type = other DNA
  modified_base order(2..5,7..8,12..13,15,17,20): mod_base = OTHER; note = 2 prime-O-methoxyethyl nucleoside
  modified_base order(1,6,9..11,14,16,18..19): mod_base = OTHER; note = 2 prime-O-methoxyethyl-5-methylcytidine
  modified_base 1..20: mod_base = OTHER; note = phosphorothioate linkage
cgaatctacccatctctcca

SEQ ID NO: 887 - DNA, 20 bp, synthetic construct
  source 1..20: mol_type = other DNA
  modified_base order(2,4..7,9..10,14..15,17,19): mod_base = OTHER; note = 2 prime-O-methoxyethyl nucleoside
  modified_base order(1,3,8,11..13,16,18,20): mod_base = OTHER; note = 2 prime-O-methoxyethyl-5-methylcytidine
  modified_base 1..20: mod_base = OTHER; note = phosphorothioate linkage
cacgaatctacccatctctc

SEQ ID NO: 888 - DNA, 20 bp, synthetic construct
  source 1..20: mol_type = other DNA
  modified_base order(1,3..6,8..9,13..14,16,18): mod_base = OTHER; note = 2 prime-O-methoxyethyl nucleoside
  modified_base order(2,7,10..12,15,17,19..20): mod_base = OTHER; note = 2 prime-O-methoxyethyl-5-methylcytidine
  modified_base 1..20: mod_base = OTHER; note = phosphorothioate linkage
acgaatctacccatctctcc

SEQ ID NO: 889 - DNA, 20 bp, synthetic construct
  source 1..20: mol_type = other DNA
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base order(2,19): mod_base = OTHER; note = 2 prime-4 prime methylene bridge nucleoside
  modified_base order(1,20): mod_base = OTHER; note = 2 prime-4 prime methylene bridge 5-methylcytidine
  modified_base order(1^2,4..20): mod_base = OTHER; note = phosphorothioate linkage
cgaatctaccatccatgtac

SEQ ID NO: 890 - DNA, 20 bp, synthetic construct
  source 1..20: mol_type = other DNA
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base order(2,19): mod_base = OTHER; note = 2 prime-4 prime methylene bridge nucleoside
  modified_base order(1,20): mod_base = OTHER; note = 2 prime-4 prime methylene bridge 5-methylcytidine
  modified_base order(1..8,10..20): mod_base = OTHER; note = phosphorothioate linkage
cgaatctaccatccatgtac

SEQ ID NO: 891 - DNA, 20 bp, synthetic construct
  source 1..20: mol_type = other DNA
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base order(2,19): mod_base = OTHER; note = 2 prime-4 prime methylene bridge nucleoside
  modified_base order(1,20): mod_base = OTHER; note = 2 prime-4 prime methylene bridge 5-methylcytidine
  modified_base order(1..12,14..20): mod_base = OTHER; note = phosphorothioate linkage
cgaatctaccatccatgtac

SEQ ID NO: 892 - DNA, 20 bp, synthetic construct
  source 1..20: mol_type = other DNA
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base order(2,19): mod_base = OTHER; note = 2 prime-4 prime methylene bridge nucleoside
  modified_base order(1,20): mod_base = OTHER; note = 2 prime-4 prime methylene bridge 5-methylcytidine
  modified_base order(1..17,19^20): mod_base = OTHER; note = phosphorothioate linkage
cgaatctaccatccatgtac

SEQ ID NO: 893 - DNA, 20 bp, synthetic construct
  source 1..20: mol_type = other DNA
  modified_base order(3..5,7..8,11..12,15..19): mod_base = OTHER; note = 2 prime-O-methoxyethyl nucleoside
  modified_base order(6,13..14,20): mod_base = OTHER; note = 2 prime-O-methoxyethyl-5-methylcytidine
  modified_base 2: mod_base = OTHER; note = 2 prime-4 prime methylene bridge nucleoside
  modified_base order(1,9..10): mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 894 - DNA, 20 bp, synthetic construct
  source 1..20: mol_type = other DNA
  modified_base order(2..5,7..8,15..19): mod_base = OTHER; note = 2 prime-O-methoxyethyl nucleoside
  modified_base order(1,6,13..14,20): mod_base = OTHER; note = 2 prime-O-methoxyethyl-5-methylcytidine
  modified_base 11..12: mod_base = OTHER; note = 2 prime-4 prime methylene bridge nucleoside
  modified_base 9..10: mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 895 - DNA, 20 bp, synthetic construct
  source 1..20: mol_type = other DNA
  modified_base order(2..5,7..8,15..18): mod_base = OTHER; note = 2 prime-O-methoxyethyl nucleoside
  modified_base order(1,6,9..10,13..14): mod_base = OTHER; note = 2 prime-O-methoxyethyl-5-methylcytidine
  modified_base order(11..12,19): mod_base = OTHER; note = 2 prime-4 prime methylene bridge nucleoside
  modified_base 20: mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 896 - DNA, 20 bp, synthetic construct
  source 1..20: mol_type = other DNA
  modified_base order(3..5,7..8,12,15..18): mod_base = OTHER; note = 2 prime-O-methoxyethyl nucleoside
  modified_base order(6,9,13..14): mod_base = OTHER; note = 2 prime-O-methoxyethyl-5-methylcytidine
  modified_base order(2,11,19): mod_base = OTHER; note = 2 prime-4 prime methylene bridge nucleoside
  modified_base order(1,10,20): mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 897 - DNA, 20 bp, synthetic construct
  source 1..20: mol_type = other DNA
  modified_base order(3,7..8,11..12,15..19): mod_base = OTHER; note = 2 prime-O-methoxyethyl nucleoside
  modified_base order(6,9..10,13..14,20): mod_base = OTHER; note = 2 prime-O-methoxyethyl-5-methylcytidine
  modified_base order(2,4..5): mod_base = OTHER; note = 2 prime-4 prime methylene bridge nucleoside
  modified_base 1: mod_base = OTHER; note = 2 prime-4 prime methylene bridge 5-methylcytidine
  modified_base 1..20: mod_base = OTHER; note = phosphorothioate linkage
cgaatctaccatccatgtac

SEQ ID NO: 898 - DNA, 20 bp, synthetic construct
  source 1..20: mol_type = other DNA
  modified_base order(2..5,7..8,11..12,15,18): mod_base = OTHER; note = 2 prime-O-methoxyethyl nucleoside
  modified_base order(1,6,9..10,13..14): mod_base = OTHER; note = 2 prime-O-methoxyethyl-5-methylcytidine
  modified_base order(16..17,19): mod_base = OTHER; note = 2 prime-4 prime methylene bridge nucleoside
  modified_base 20: mod_base = OTHER; note = 2 prime-4 prime methylene bridge 5-methylcytidine
  modified_base 1..20: mod_base = OTHER; note = phosphorothioate linkage
cgaatctaccatccagttac

SEQ ID NO: 899 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 900 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..21,25^26): mod_base = OTHER; note = phosphorothioate linkage
cgaatctacccacatctgttcaatca

SEQ ID NO: 901 - DNA, 26 bp, synthetic construct
  source 1..26: mol_type = other DNA
  modified_base order(2,4..7,9..10,16..17,20..24,26): mod_base = OTHER; note = 2 prime-O-methoxyethyl nucleoside
  modified_base order(1,3,8,11..15,18..19,25): mod_base = OTHER; note = 2 prime-O-methoxyethyl-5-methylcytidine
  modified_base order(1..20,25^26): mod_base = OTHER; note = phosphorothioate linkage
cacgaatctacccccatccatgtact

SEQ ID NO: 902 - DNA, 26 bp, synthetic construct
  source 1..26: mol_type = other DNA
  modified_base order(3..4,7..8,10..11,14..25): mod_base = OTHER; note = 2 prime-O-methoxyethyl nucleoside
  modified_base order(1..2,5..6,9,12..13,26): mod_base = OTHER; note = 2 prime-O-methoxyethyl-5-methylcytidine
  modified_base order(1..20,25^26): mod_base = OTHER; note = phosphorothioate linkage
ccatccatcatccgggataagagttc

SEQ ID NO: 903 - DNA, 26 bp, synthetic construct
  source 1..26: mol_type = other DNA
  modified_base order(1,3..9,11..12,14..26): mod_base = OTHER; note = 2 prime-O-methoxyethyl nucleoside
  modified_base order(2,10,13): mod_base = OTHER; note = 2 prime-O-methoxyethyl-5-methylcytidine
  modified_base order(1..20,25^26): mod_base = OTHER; note = phosphorothioate linkage
gcatttattcaacggggataagagtt

SEQ ID NO: 904 - DNA, 26 bp, synthetic construct
  source 1..26: mol_type = other DNA
  modified_base order(1,25..26): mod_base = OTHER; note = 2 prime-4 prime methylene bridge nucleoside
  modified_base 2: mod_base = OTHER; note = 2 prime-4 prime methylene bridge-5-methylcytidine
  modified_base order(3..9,11..12,14..24): mod_base = OTHER; note = 2 prime-O-methoxyethyl nucleoside
  modified_base order(10,13): mod_base = OTHER; note = 2 prime-O-methoxyethyl-5-methylcytidine
  modified_base 1..26: mod_base = OTHER; note = phosphorothioate linkage
gcatttattcaacggggataagagtt

SEQ ID NO: 905 - DNA, 26 bp, synthetic construct
  source 1..26: mol_type = other DNA
  modified_base order(3,25..26): mod_base = OTHER; note = 2 prime-4 prime methylene bridge nucleoside
  modified_base 2: mod_base = OTHER; note = 2 prime-4 prime methylene bridge-5-methylcytidine
  modified_base order(1,4..9,11..12,14..24): mod_base = OTHER; note = 2 prime-O-methoxyethyl nucleoside
  modified_base order(10,13): mod_base = OTHER; note = 2 prime-O-methoxyethyl-5-methylcytidine
  modified_base order(1^2,4..26): mod_base = OTHER; note = phosphorothioate linkage
gcatttattcaacggggataagagtt

SEQ ID NO: 906 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base order(1^2,4..26): mod_base = OTHER; note = phosphorothioate linkage
gcatttattcaacgggataagagttc

SEQ ID NO: 907 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base order(1..11,13..26): mod_base = OTHER; note = phosphorothioate linkage
gcatttattcaacgggataagagttc

SEQ ID NO: 908 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base order(1..15,17..26): mod_base = OTHER; note = phosphorothioate linkage
gcatttattcaacgggataagagttc

SEQ ID NO: 909 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base order(1..23,25^26): mod_base = OTHER; note = phosphorothioate linkage
gcatttattcaacgggataagagttc

SEQ ID NO: 910 - DNA, 26 bp, synthetic construct
  source 1..26: mol_type = other DNA
  modified_base order(1,3..9,11..12,14..25): mod_base = OTHER; note = 2 prime-O-methoxyethyl nucleoside
  modified_base order(2,10,13,26): mod_base = OTHER; note = 2 prime-O-methoxyethyl-5-methylcytidine
  modified_base order(1..20,25^26): mod_base = OTHER; note = phosphorothioate linkage
gcatttattcaacgggataagagttc

SEQ ID NO: 911 - DNA, 26 bp, synthetic construct
  source 1..26: mol_type = other DNA
  modified_base order(1,3..9,11..12,14..24,26): mod_base = OTHER; note = 2 prime-O-methoxyethyl nucleoside
  modified_base order(2,10,13,25): mod_base = OTHER; note = 2 prime-O-methoxyethyl-5-methylcytidine
  modified_base order(1..20,25^26): mod_base = OTHER; note = phosphorothioate linkage
gcatttattcaacggataagagttct

SEQ ID NO: 912 - DNA, 24 bp, synthetic construct
  source 1..24: mol_type = other DNA
  modified_base order(2..4,11,13..14,21..23): mod_base = OTHER; note = 2 prime-4 prime methylene bridge nucleoside
  modified_base order(1,12,24): mod_base = OTHER; note = 2 prime-4 prime methylene bridge-5-methylcytidine
  modified_base order(5..8,10,15..20): mod_base = OTHER; note = 2 prime-O-methoxyethyl nucleoside
  modified_base 9: mod_base = OTHER; note = 2 prime-O-methoxyethyl-5-methylcytidine
  modified_base 1..24: mod_base = OTHER; note = phosphorothioate linkage
catttattcaacggataagagttc

SEQ ID NO: 913 - DNA, 24 bp, synthetic construct
  source 1..24: mol_type = other DNA
  modified_base order(2..8,10..11,13..23): mod_base = OTHER; note = 2 prime-O-methoxyethyl nucleoside
  modified_base order(1,9,12,24): mod_base = OTHER; note = 2 prime-O-methoxyethyl-5-methylcytidine
  modified_base 1..24: mod_base = OTHER; note = phosphorothioate linkage
catttattcaacggataagagttc

SEQ ID NO: 914 - DNA, 24 bp, synthetic construct
  source 1..24: mol_type = other DNA
  modified_base order(2..8,10..11,13..24): mod_base = OTHER; note = 2 prime-O-methoxyethyl nucleoside
  modified_base order(1,9,12): mod_base = OTHER; note = 2 prime-O-methoxyethyl-5-methylcytidine
  modified_base 1..24: mod_base = OTHER; note = phosphorothioate linkage
catttattcaacgggataagagtt

SEQ ID NO: 915 - DNA, 25 bp, synthetic construct
  source 1..25: mol_type = other DNA
  modified_base order(2..8,10..11,13..25): mod_base = OTHER; note = 2 prime-O-methoxyethyl nucleoside
  modified_base order(1,9,12): mod_base = OTHER; note = 2 prime-O-methoxyethyl-5-methylcytidine
  modified_base 1..25: mod_base = OTHER; note = phosphorothioate linkage
catttattcaacggggataagagtt

SEQ ID NO: 916 - DNA, 25 bp, synthetic construct
  source 1..25: mol_type = other DNA
  modified_base order(1,3..9,11..25): mod_base = OTHER; note = 2 prime-O-methoxyethyl nucleoside
  modified_base order(2,10): mod_base = OTHER; note = 2 prime-O-methoxyethyl-5-methylcytidine
  modified_base 1..25: mod_base = OTHER; note = phosphorothioate linkage
gcatttattcaaggggataagagtt

SEQ ID NO: 917 - DNA, 25 bp, synthetic construct
  source 1..25: mol_type = other DNA
  modified_base order(1,3..9,11..12,14..25): mod_base = OTHER; note = 2 prime-O-methoxyethyl nucleoside
  modified_base order(2,10,13): mod_base = OTHER; note = 2 prime-O-methoxyethyl-5-methylcytidine
  modified_base 1..25: mod_base = OTHER; note = phosphorothioate linkage
gcatttattcaacgggataagagtt

SEQ ID NO: 918 - DNA, 25 bp, synthetic construct
  source 1..25: mol_type = other DNA
  modified_base order(1,3..9,11..12,14..25): mod_base = OTHER; note = 2 prime-O-methoxyethyl nucleoside
  modified_base order(2,10,13): mod_base = OTHER; note = 2 prime-O-methoxyethyl-5-methylcytidine
  modified_base 1..25: mod_base = OTHER; note = phosphorothioate linkage
gcatttattcaacggggataagagt

SEQ ID NO: 919 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,4..26): mod_base = OTHER; note = phosphorothioate linkage
tgttcaatcattcgggataagagttc

SEQ ID NO: 920 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..11,13..26): mod_base = OTHER; note = phosphorothioate linkage
tgttcaatcattcgggataagagttc

SEQ ID NO: 921 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..15,17..26): mod_base = OTHER; note = phosphorothioate linkage
tgttcaatcattcgggataagagttc

SEQ ID NO: 922 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..23,25^26): mod_base = OTHER; note = phosphorothioate linkage
tgttcaatcattcgggataagagttc

SEQ ID NO: 923 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 924 - DNA, 25 bp, synthetic construct
  source 1..25: mol_type = other DNA
  modified_base order(1..4,6..8,10..24): mod_base = OTHER; note = 2 prime-O-methoxyethyl nucleoside
  modified_base order(5,9,25): mod_base = OTHER; note = 2 prime-O-methoxyethyl-5-methylcytidine
  modified_base 1..25: mod_base = OTHER; note = phosphorothioate linkage
tgttcaatcattgggataagagttc

SEQ ID NO: 925 - DNA, 25 bp, synthetic construct
  source 1..25: mol_type = other DNA
  modified_base order(1..4,6..8,10..12,14..25): mod_base = OTHER; note = 2 prime-O-methoxyethyl nucleoside
  modified_base order(5,9,13): mod_base = OTHER; note = 2 prime-O-methoxyethyl-5-methylcytidine
  modified_base 1..25: mod_base = OTHER; note = phosphorothioate linkage
tgttcaatcattcgggataagagtt

SEQ ID NO: 926 - skipped

SEQ ID NO: 927 - DNA, 26 bp, synthetic construct
  source 1..26: mol_type = other DNA
  modified_base 1..2: mod_base = OTHER; note = 2 prime-4 prime methylene bridge nucleoside
  modified_base order(3..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 928 - DNA, 26 bp, synthetic construct
  source 1..26: mol_type = other DNA
  modified_base 3..4: mod_base = OTHER; note = 2 prime-4 prime methylene bridge nucleoside
  modified_base order(1..2,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 929 - DNA, 26 bp, synthetic construct
  source 1..26: mol_type = other DNA
  modified_base 6: mod_base = OTHER; note = 2 prime-4 prime methylene bridge nucleoside
  modified_base 5: mod_base = OTHER; note = 2 prime-4 prime methylene bridge-5-methylcytidine
  modified_base order(1..4,7..8,10..12,14..25): mod_base = OTHER; note = 2 prime-O-methoxyethyl nucleoside
  modified_base order(9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 930 - DNA, 26 bp, synthetic construct
  source 1..26: mol_type = other DNA
  modified_base 7..8: mod_base = OTHER; note = 2 prime-4 prime methylene bridge nucleoside
  modified_base order(1..4,6,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 931 - DNA, 26 bp, synthetic construct
  source 1..26: mol_type = other DNA
  modified_base 10: mod_base = OTHER; note = 2 prime-4 prime methylene bridge nucleoside
  modified_base 9: mod_base = OTHER; note = 2 prime-4 prime methylene bridge-5-methylcytidine
  modified_base order(1..4,6..8,11..12,14..25): mod_base = OTHER; note = 2 prime-O-methoxyethyl nucleoside
  modified_base order(5,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 932 - DNA, 26 bp, synthetic construct
  source 1..26: mol_type = other DNA
  modified_base 11..12: mod_base = OTHER; note = 2 prime-4 prime methylene bridge nucleoside
  modified_base order(1..4,6..8,10,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 933 - DNA, 26 bp, synthetic construct
  source 1..26: mol_type = other DNA
  modified_base 14: mod_base = OTHER; note = 2 prime-4 prime methylene bridge nucleoside
  modified_base 13: mod_base = OTHER; note = 2 prime-4 prime methylene bridge-5-methylcytidine
  modified_base order(1..4,6..8,10..12,15..25): mod_base = OTHER; note = 2 prime-O-methoxyethyl nucleoside
  modified_base order(5,9,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 934 - DNA, 26 bp, synthetic construct
  source 1..26: mol_type = other DNA
  modified_base 15..16: mod_base = OTHER; note = 2 prime-4 prime methylene bridge nucleoside
  modified_base order(1..4,6..8,10..12,14,17..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 935 - DNA, 26 bp, synthetic construct
  source 1..26: mol_type = other DNA
  modified_base 17..18: mod_base = OTHER; note = 2 prime-4 prime methylene bridge nucleoside
  modified_base order(1..4,6..8,10..12,14..16,19..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 936 - DNA, 26 bp, synthetic construct
  source 1..26: mol_type = other DNA
  modified_base 19..20: mod_base = OTHER; note = 2 prime-4 prime methylene bridge nucleoside
  modified_base order(1..4,6..8,10..12,14..18,21..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 937 - DNA, 26 bp, synthetic construct
  source 1..26: mol_type = other DNA
  modified_base 21..22: mod_base = OTHER; note = 2 prime-4 prime methylene bridge nucleoside
  modified_base order(1..4,6..8,10..12,14..20,23..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 938 - DNA, 26 bp, synthetic construct
  source 1..26: mol_type = other DNA
  modified_base 23..24: mod_base = OTHER; note = 2 prime-4 prime methylene bridge nucleoside
  modified_base order(1..4,6..8,10..12,14..22,25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 939 - DNA, 26 bp, synthetic construct
  source 1..26: mol_type = other DNA
  modified_base 25: mod_base = OTHER; note = 2 prime-4 prime methylene bridge nucleoside
  modified_base 26: mod_base = OTHER; note = 2 prime-4 prime methylene bridge-5-methylcytidine
  modified_base order(1..4,6..8,10..12,14..24): mod_base = OTHER; note = 2 prime-O-methoxyethyl nucleoside
  modified_base order(5,9,13): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 940 - DNA, 26 bp, synthetic construct
  source 1..26: mol_type = other DNA
  modified_base order(3..4,11..12): mod_base = OTHER; note = 2 prime-4 prime methylene bridge nucleoside
  modified_base order(1..2,6..8,10,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 941 - DNA, 26 bp, synthetic construct
  source 1..26: mol_type = other DNA
  modified_base 6..7: mod_base = OTHER; note = 2 prime-4 prime methylene bridge nucleoside
  modified_base order(1..4,8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 942 - DNA, 26 bp, synthetic construct
  source 1..26: mol_type = other DNA
  modified_base order(6..7,19..20): mod_base = OTHER; note = 2 prime-4 prime methylene bridge nucleoside
  modified_base order(1..4,8,10..12,14..18,21..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,25^26): mod_base = OTHER; note = phosphorothioate linkage
tgttcaatcattcgggataagagttc

SEQ ID NO: 943 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..14,17..20,25^26): mod_base = OTHER; note = phosphorothioate linkage
tgttcaatcattcgggataagagttc

SEQ ID NO: 944 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..11,13..15,17..26): mod_base = OTHER; note = phosphorothioate linkage
tgttcaatcattcgggataagagttc

SEQ ID NO: 945 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,4..11,13..26): mod_base = OTHER; note = phosphorothioate linkage
tgttcaatcattcgggataagagttc

SEQ ID NO: 946 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,4..15,17..26): mod_base = OTHER; note = phosphorothioate linkage
tgttcaatcattcgggataagagttc

SEQ ID NO: 947 - DNA, 29 bp, synthetic construct
  source 1..29: mol_type = other DNA
  modified_base order(4..7,9..11,13..15,17..28): mod_base = OTHER; note = 2 prime-O-methoxyethyl nucleoside
  modified_base order(8,12,16,29): mod_base = OTHER; note = 2 prime-O-methoxyethyl-5-methylcytidine
  modified_base order(4..23,28^29): mod_base = OTHER; note = phosphorothioate linkage
  misc_feature <1: note = linked to [(1-oxohexadecyl)amino]hexyl]phosphoryl
tcatgttcaatcattcgggataagagttc

SEQ ID NO: 948 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1^2,5..20): mod_base = OTHER; note = phosphorothioate linkage
tgttcaatcattcgggataagagttc

SEQ ID NO: 949 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..4,7..26): mod_base = OTHER; note = phosphorothioate linkage
tgttcaatcattcgggataagagttc

SEQ ID NO: 950 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..6,9..26): mod_base = OTHER; note = phosphorothioate linkage
tgttcaatcattcgggataagagttc

SEQ ID NO: 951 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..8,11..26): mod_base = OTHER; note = phosphorothioate linkage
tgttcaatcattcgggataagagttc

SEQ ID NO: 952 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..10,13..26): mod_base = OTHER; note = phosphorothioate linkage
tgttcaatcattcgggataagagttc

SEQ ID NO: 953 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..12,15..26): mod_base = OTHER; note = phosphorothioate linkage
tgttcaatcattcgggataagagttc

SEQ ID NO: 954 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..14,17..26): mod_base = OTHER; note = phosphorothioate linkage
tgttcaatcattcgggataagagttc

SEQ ID NO: 955 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..16,19..26): mod_base = OTHER; note = phosphorothioate linkage
tgttcaatcattcgggataagagttc

SEQ ID NO: 956 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..18,21..26): mod_base = OTHER; note = phosphorothioate linkage
tgttcaatcattcgggataagagttc

SEQ ID NO: 957 - DNA, 26 bp, synthetic construct
  source 1..26: mol_type = other DNA
  modified_base order(1..4,6..8,10..12,14..25): mod_base = OTHER; note = 2 prime-O-methoxyethyl nucleoside
  modified_base order(5,9,13,26): mod_base = OTHER; note = 2 prime-O-methoxyethyl-5-methylcytidine
  modified_base order(1..20,23..26): mod_base = OTHER; note = phosphorothioate linkage
tgttcaatcattcgggataagagttc

SEQ ID NO: 958 - DNA, 13 bp, synthetic construct
  source 1..13: mol_type = other DNA
  modified_base order(1..4,6..8,10..12): mod_base = OTHER; note = 2 prime-O-methoxyethyl nucleoside
  modified_base order(5,9,13): mod_base = OTHER; note = 2 prime-O-methoxyethyl-5-methylcytidine
  modified_base 1..13: mod_base = OTHER; note = phosphorothioate linkage
tgttcaatcattc

SEQ ID NO: 959 - DNA, 13 bp, synthetic construct
  source 1..13: mol_type = other DNA
  modified_base 1..12: mod_base = OTHER; note = 2 prime-O-methoxyethyl nucleoside
  modified_base 13: mod_base = OTHER; note = 2 prime-O-methoxyethyl-5-methylcytidine
  modified_base order(2..8,12^13): mod_base = OTHER; note = phosphorothioate linkage
gggataagagttc

SEQ ID NO: 960 - DNA, 26 bp, synthetic construct
  source 1..26: mol_type = other DNA
  modified_base order(1,3..6,8..10,12..26): mod_base = OTHER; note = 2 prime-O-methoxyethyl nucleoside
  modified_base order(2,7,11): mod_base = OTHER; note = 2 prime-O-methoxyethyl-5-methylcytidine
  modified_base order(1..20,25^26): mod_base = OTHER; note = phosphorothioate linkage
tctgttcaatcattggggataagagt

SEQ ID NO: 961 - DNA, 26 bp, synthetic construct
  source 1..26: mol_type = other DNA
  modified_base order(1,3..6,8..10,12..26): mod_base = OTHER; note = 2 prime-O-methoxyethyl nucleoside
  modified_base order(2,7,11): mod_base = OTHER; note = 2 prime-O-methoxyethyl-5-methylcytidine
  modified_base order(1..20,25^26): mod_base = OTHER; note = phosphorothioate linkage
tctgttcaatcatggggataagagtt

SEQ ID NO: 962 - DNA, 26 bp, synthetic construct
  source 1..26: mol_type = other DNA
  modified_base order(1,3..6,8..10,12..25): mod_base = OTHER; note = 2 prime-O-methoxyethyl nucleoside
  modified_base order(2,7,11,26): mod_base = OTHER; note = 2 prime-O-methoxyethyl-5-methylcytidine
  modified_base order(1..20,25^26): mod_base = OTHER; note = phosphorothioate linkage
tctgttcaatcatgggataagagttc

SEQ ID NO: 963 - DNA, 26 bp, synthetic construct
  source 1..26: mol_type = other DNA
  modified_base order(2..5,7..9,11..26): mod_base = OTHER; note = 2 prime-O-methoxyethyl nucleoside
  modified_base order(1,6,10): mod_base = OTHER; note = 2 prime-O-methoxyethyl-5-methylcytidine
  modified_base order(1..20,25^26): mod_base = OTHER; note = phosphorothioate linkage
ctgttcaatcatttggggataagagt

SEQ ID NO: 964 - DNA, 26 bp, synthetic construct
  source 1..26: mol_type = other DNA
  modified_base order(2..5,7..9,11..26): mod_base = OTHER; note = 2 prime-O-methoxyethyl nucleoside
  modified_base order(1,6,10): mod_base = OTHER; note = 2 prime-O-methoxyethyl-5-methylcytidine
  modified_base order(1..20,25^26): mod_base = OTHER; note = phosphorothioate linkage
ctgttcaatcattggggataagagtt

SEQ ID NO: 965 - DNA, 26 bp, synthetic construct
  source 1..26: mol_type = other DNA
  modified_base order(2..5,7..9,11..25): mod_base = OTHER; note = 2 prime-O-methoxyethyl nucleoside
  modified_base order(1,6,10,26): mod_base = OTHER; note = 2 prime-O-methoxyethyl-5-methylcytidine
  modified_base order(1..20,25^26): mod_base = OTHER; note = phosphorothioate linkage
ctgttcaatcattgggataagagttc

SEQ ID NO: 966 - DNA, 26 bp, synthetic construct
  source 1..26: mol_type = other DNA
  modified_base order(1..4,6..8,10..12,14..26): mod_base = OTHER; note = 2 prime-O-methoxyethyl nucleoside
  modified_base order(5,9,13): mod_base = OTHER; note = 2 prime-O-methoxyethyl-5-methylcytidine
  modified_base order(1..20,25^26): mod_base = OTHER; note = phosphorothioate linkage
tgttcaatcattctggggataagagt

SEQ ID NO: 967 - DNA, 26 bp, synthetic construct
  source 1..26: mol_type = other DNA
  modified_base order(1..4,6..8,10..12,14..26): mod_base = OTHER; note = 2 prime-O-methoxyethyl nucleoside
  modified_base order(5,9,13): mod_base = OTHER; note = 2 prime-O-methoxyethyl-5-methylcytidine
  modified_base order(1..20,25^26): mod_base = OTHER; note = phosphorothioate linkage
tgttcaatcattcggggataagagtt

SEQ ID NO: 968 - DNA, 26 bp, synthetic construct
  source 1..26: mol_type = other DNA
  modified_base order(1..4,6..8,10..12,14..24,26): mod_base = OTHER; note = 2 prime-O-methoxyethyl nucleoside
  modified_base order(5,9,13,25): mod_base = OTHER; note = 2 prime-O-methoxyethyl-5-methylcytidine
  modified_base order(1..20,25^26): mod_base = OTHER; note = phosphorothioate linkage
tgttcaatcattcggataagagttct

SEQ ID NO: 969 - DNA, 26 bp, synthetic construct
  source 1..26: mol_type = other DNA
  modified_base order(1..4,6..8,10..12,14..25): mod_base = OTHER; note = 2 prime-O-N-methylacetamide nucleoside
  modified_base order(5,9,13,26): mod_base = OTHER; note = 2 prime-O-N-methylacetamide-5-methylcytidine
  modified_base order(1..20,25^26): mod_base = OTHER; note = phosphorothioate linkage
tgttcaatcattcgggataagagttc

SEQ ID NO: 970 - DNA, 26 bp, synthetic construct
  source 1..26: mol_type = other DNA
  modified_base order(1,4..5,8..9,12..18,20..22,25..26): mod_base = OTHER; note = 2 prime-O-methoxyethyl nucleoside
  modified_base order(2..3,6..7,10..11,19,23..24): mod_base = OTHER; note = 2 prime-O-methoxyethyl-5-methylcytidine
  modified_base 1..26: mod_base = OTHER; note = phosphorothioate linkage
tccatccatccttgagttctttccag

SEQ ID NO: 971 - DNA, 13 bp, synthetic construct
  source 1..13: mol_type = other DNA
  modified_base order(1,4..5,8..9,12..13): mod_base = OTHER; note = 2 prime-O-methoxyethyl nucleoside
  modified_base order(2..3,6..7,10..11): mod_base = OTHER; note = 2 prime-O-methoxyethyl-5-methylcytidine
  modified_base 1..13: mod_base = OTHER; note = phosphorothioate linkage
tccatccatcctt

SEQ ID NO: 972 - DNA, 13 bp, synthetic construct
  source 1..13: mol_type = other DNA
  modified_base order(1..5,7..9,12..13): mod_base = OTHER; note = 2 prime-O-methoxyethyl nucleoside
  modified_base order(6,10..11): mod_base = OTHER; note = 2 prime-O-methoxyethyl-5-methylcytidine
  modified_base 2..13: mod_base = OTHER; note = phosphorothioate linkage
gagttctttccag

SEQ ID NO: 973 - DNA, 26 bp, synthetic construct
  source 1..26: mol_type = other DNA
  modified_base order(2,4,7..8,11..12,14..15,17..19,22..26): mod_base = OTHER; note = 2 prime-O-methoxyethyl nucleoside
  modified_base order(1,3,5..6,9..10,13,16,20..21): mod_base = OTHER; note = 2 prime-O-methoxyethyl-5-methylcytidine
  modified_base 1..26: mod_base = OTHER; note = phosphorothioate linkage
ctctccatccatcttctttccaggaa

SEQ ID NO: 974 - DNA, 26 bp, synthetic construct
  source 1..26: mol_type = other DNA
  modified_base 12..15: mod_base = OTHER; note = 2 prime-4 prime methylene bridge nucleoside
  modified_base order(1,4..5,8..9,16..18,20..22,25..26): mod_base = OTHER; note = 2 prime-O-methoxyethyl nucleoside
  modified_base order(2..3,6..7,10..11,19,23..24): mod_base = OTHER; note = 2 prime-O-methoxyethyl-5-methylcytidine
  modified_base 1..26: mod_base = OTHER; note = phosphorothioate linkage
tccatccatccttgagttctttccag

SEQ ID NO: 975 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base order(1^2,4..26): mod_base = OTHER; note = phosphorothioate linkage
catccatctatccgggataagagttc

SEQ ID NO: 976 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base order(1..11,13..26): mod_base = OTHER; note = phosphorothioate linkage
catccatctatccgggataagagttc

SEQ ID NO: 977 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base order(1..15,17..26): mod_base = OTHER; note = phosphorothioate linkage
catccatctatccgggataagagttc

SEQ ID NO: 978 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base order(1..23,25^26): mod_base = OTHER; note = phosphorothioate linkage
catccatctatccgggataagagttc

SEQ ID NO: 979 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base order(1..20,25^26): mod_base = OTHER; note = phosphorothioate linkage
catccatctatccgggataagagttc

SEQ ID NO: 980 - DNA, 24 bp, synthetic construct
  source 1..24: mol_type = other DNA
  modified_base order(1..2,13,23): mod_base = OTHER; note = 2 prime-4 prime methylene bridge nucleoside
  modified_base order(12,24): mod_base = OTHER; note = 2 prime-4 prime methylene bridge-5-methylcytidine
  modified_base order(5..6,8..10,14..22): mod_base = OTHER; note = 2 prime-O-methoxyethyl nucleoside
  modified_base order(3..4,7,11): mod_base = OTHER; note = 2 prime-O-methoxyethyl-5-methylcytidine
  modified_base 1..24: mod_base = OTHER; note = phosphorothioate linkage
atccatctatccggataagagttc

SEQ ID NO: 981 - DNA, 24 bp, synthetic construct
  source 1..24: mol_type = other DNA
  modified_base order(1..2,13,23..24): mod_base = OTHER; note = 2 prime-4 prime methylene bridge nucleoside
  modified_base 12: mod_base = OTHER; note = 2 prime-4 prime methylene bridge-5-methylcytidine
  modified_base order(5..6,8..10,14..22): mod_base = OTHER; note = 2 prime-O-methoxyethyl nucleoside
  modified_base order(3..4,7,11): mod_base = OTHER; note = 2 prime-O-methoxyethyl-5-methylcytidine
  modified_base 1..24: mod_base = OTHER; note = phosphorothioate linkage
atccatctatccgggataagagtt

SEQ ID NO: 982 - DNA, 24 bp, synthetic construct
  source 1..24: mol_type = other DNA
  modified_base order(1..2,5..6,8..10,13..23): mod_base = OTHER; note = 2 prime-O-methoxyethyl nucleoside
  modified_base order(3..4,7,11..12,24): mod_base = OTHER; note = 2 prime-O-methoxyethyl-5-methylcytidine
  modified_base 1..24: mod_base = OTHER; note = phosphorothioate linkage
atccatctatccggataagagttc

SEQ ID NO: 983 - DNA, 24 bp, synthetic construct
  source 1..24: mol_type = other DNA
  modified_base order(1..2,5..6,8..10,13..24): mod_base = OTHER; note = 2 prime-O-methoxyethyl nucleoside
  modified_base order(3..4,7,11..12): mod_base = OTHER; note = 2 prime-O-methoxyethyl-5-methylcytidine
  modified_base 1..24: mod_base = OTHER; note = phosphorothioate linkage
atccatctatccgggataagagtt

SEQ ID NO: 984 - DNA, 26 bp, synthetic construct
  source 1..26: mol_type = other DNA
  modified_base order(2..3,5,7..8,11..12,14..19,21..23,26): mod_base = OTHER; note = 2 prime-O-methoxyethyl nucleoside
  modified_base order(1,4,6,9..10,13,20,24..25): mod_base = OTHER; note = 2 prime-O-methoxyethyl-5-methylcytidine
  modified_base 1..26: mod_base = OTHER; note = phosphorothioate linkage
caactcatccatcagagttctttcca

SEQ ID NO: 985 - DNA, 26 bp, synthetic construct
  source 1..26: mol_type = other DNA
  modified_base order(1,4,6..9,11..12,14..24,26): mod_base = OTHER; note = 2 prime-O-methoxyethyl nucleoside
  modified_base order(2..3,5,10,13,25): mod_base = OTHER; note = 2 prime-O-methoxyethyl-5-methylcytidine
  modified_base 1..26: mod_base = OTHER; note = phosphorothioate linkage
gccacgaatctacggataagagttct

SEQ ID NO: 986 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base order(1^2,4..26): mod_base = OTHER; note = phosphorothioate linkage
ccacgaatctaccgggataagagttc

SEQ ID NO: 987 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base order(1..11,13..26): mod_base = OTHER; note = phosphorothioate linkage
ccacgaatctaccgggataagagttc

SEQ ID NO: 988 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base order(1..15,17..26): mod_base = OTHER; note = phosphorothioate linkage
ccacgaatctaccgggataagagttc

SEQ ID NO: 989 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base order(1..23,25^26): mod_base = OTHER; note = phosphorothioate linkage
ccacgaatctaccgggataagagttc

SEQ ID NO: 990 - DNA, 26 bp, synthetic construct
  source 1..26: mol_type = other DNA
  modified_base order(3,5..8,10..11,14..25): mod_base = OTHER; note = 2 prime-O-methoxyethyl nucleoside
  modified_base order(1..2,4,9,12..13,26): mod_base = OTHER; note = 2 prime-O-methoxyethyl-5-methylcytidine
  modified_base order(1..20,25^26): mod_base = OTHER; note = phosphorothioate linkage
ccacgaatctaccgggataagagttc

SEQ ID NO: 991 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base order(1^2,4..26): mod_base = OTHER; note = phosphorothioate linkage
ccacgaatctaccggataagagttct

SEQ ID NO: 992 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base order(1..11,13..26): mod_base = OTHER; note = phosphorothioate linkage
ccacgaatctaccggataagagttct

SEQ ID NO: 993 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base order(1..15,17..26): mod_base = OTHER; note = phosphorothioate linkage
ccacgaatctaccggataagagttct

SEQ ID NO: 994 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base order(1..23,25^26): mod_base = OTHER; note = phosphorothioate linkage
ccacgaatctaccggataagagttct

SEQ ID NO: 995 - DNA, 26 bp, synthetic construct
  source 1..26: mol_type = other DNA
  modified_base order(3,5..8,10..11,14..24,26): mod_base = OTHER; note = 2 prime-O-methoxyethyl nucleoside
  modified_base order(1..2,4,9,12..13,25): mod_base = OTHER; note = 2 prime-O-methoxyethyl-5-methylcytidine
  modified_base order(1..20,25^26): mod_base = OTHER; note = phosphorothioate linkage
ccacgaatctaccggataagagttct

SEQ ID NO: 996 - DNA, 24 bp, synthetic construct
  source 1..24: mol_type = other DNA
  modified_base order(2,4..7,9..10,13..22,24): mod_base = OTHER; note = 2 prime-O-methoxyethyl nucleoside
  modified_base order(1,3,8,11..12,23): mod_base = OTHER; note = 2 prime-O-methoxyethyl-5-methylcytidine
  modified_base 1..24: mod_base = OTHER; note = phosphorothioate linkage
cacgaatctaccgataagagttct

SEQ ID NO: 997 - DNA, 24 bp, synthetic construct
  source 1..24: mol_type = other DNA
  modified_base order(3,5..8,10..11,13..22,24): mod_base = OTHER; note = 2 prime-O-methoxyethyl nucleoside
  modified_base order(1..2,4,9,12,23): mod_base = OTHER; note = 2 prime-O-methoxyethyl-5-methylcytidine
  modified_base 1..24: mod_base = OTHER; note = phosphorothioate linkage
ccacgaatctacgataagagttct

SEQ ID NO: 998 - DNA, 24 bp, synthetic construct
  source 1..24: mol_type = other DNA
  modified_base order(2,4..7,9..10,13..24): mod_base = OTHER; note = 2 prime-O-methoxyethyl nucleoside
  modified_base order(1,3,8,11..12): mod_base = OTHER; note = 2 prime-O-methoxyethyl-5-methylcytidine
  modified_base 1..24: mod_base = OTHER; note = phosphorothioate linkage
cacgaatctaccggggataagagt

SEQ ID NO: 999 - DNA, 24 bp, synthetic construct
  source 1..24: mol_type = other DNA
  modified_base order(3,5..8,10..11,13..24): mod_base = OTHER; note = 2 prime-O-methoxyethyl nucleoside
  modified_base order(1..2,4,9,12): mod_base = OTHER; note = 2 prime-O-methoxyethyl-5-methylcytidine
  modified_base 1..24: mod_base = OTHER; note = phosphorothioate linkage
ccacgaatctacggggataagagt

SEQ ID NO: 1000 - DNA, 24 bp, synthetic construct
  source 1..24: mol_type = other DNA
  modified_base order(2,13,23): mod_base = OTHER; note = 2 prime-4 prime methylene bridge nucleoside
  modified_base order(1,12,24): mod_base = OTHER; note = 2 prime-4 prime methylene bridge-5-methylcytidine
  modified_base order(4..7,9..10,14..22): mod_base = OTHER; note = 2 prime-O-methoxyethyl nucleoside
  modified_base order(3,8,11): mod_base = OTHER; note = 2 prime-O-methoxyethyl-5-methylcytidine
  modified_base 1..24: mod_base = OTHER; note = phosphorothioate linkage
cacgaatctaccggataagagttc

SEQ ID NO: 1001 - DNA, 24 bp, synthetic construct
  source 1..24: mol_type = other DNA
  modified_base order(2,13,23..24): mod_base = OTHER; note = 2 prime-4 prime methylene bridge nucleoside
  modified_base order(1,12): mod_base = OTHER; note = 2 prime-4 prime methylene bridge-5-methylcytidine
  modified_base order(4..7,9..10,14..22): mod_base = OTHER; note = 2 prime-O-methoxyethyl nucleoside
  modified_base order(3,8,11): mod_base = OTHER; note = 2 prime-O-methoxyethyl-5-methylcytidine
  modified_base 1..24: mod_base = OTHER; note = phosphorothioate linkage
cacgaatctaccgggataagagtt

SEQ ID NO: 1002 - DNA, 24 bp, synthetic construct
  source 1..24: mol_type = other DNA
  modified_base order(13,23): mod_base = OTHER; note = 2 prime-4 prime methylene bridge nucleoside
  modified_base order(1..2,12,24): mod_base = OTHER; note = 2 prime-4 prime methylene bridge-5-methylcytidine
  modified_base order(3,5..8,10..11,14..22): mod_base = OTHER; note = 2 prime-O-methoxyethyl nucleoside
  modified_base order(4,9): mod_base = OTHER; note = 2 prime-O-methoxyethyl-5-methylcytidine
  modified_base 1..24: mod_base = OTHER; note = phosphorothioate linkage
ccacgaatctacggataagagttc

SEQ ID NO: 1003 - DNA, 24 bp, synthetic construct
  source 1..24: mol_type = other DNA
  modified_base order(13,23..24): mod_base = OTHER; note = 2 prime-4 prime methylene bridge nucleoside
  modified_base order(1..2,12): mod_base = OTHER; note = 2 prime-4 prime methylene bridge-5-methylcytidine
  modified_base order(3,5..8,10..11,14..22): mod_base = OTHER; note = 2 prime-O-methoxyethyl nucleoside
  modified_base order(4,9): mod_base = OTHER; note = 2 prime-O-methoxyethyl-5-methylcytidine
  modified_base 1..24: mod_base = OTHER; note = phosphorothioate linkage
ccacgaatctacgggataagagtt

SEQ ID NO: 1004 - DNA, 24 bp, synthetic construct
  source 1..24: mol_type = other DNA
  modified_base order(2,13,24): mod_base = OTHER; note = 2 prime-4 prime methylene bridge nucleoside
  modified_base order(1,12,23): mod_base = OTHER; note = 2 prime-4 prime methylene bridge-5-methylcytidine
  modified_base order(4..7,9..10,14..22): mod_base = OTHER; note = 2 prime-O-methoxyethyl nucleoside
  modified_base order(3,8,11): mod_base = OTHER; note = 2 prime-O-methoxyethyl-5-methylcytidine
  modified_base 1..24: mod_base = OTHER; note = phosphorothioate linkage
cacgaatctaccgataagagttct

SEQ ID NO: 1005 - DNA, 24 bp, synthetic construct
  source 1..24: mol_type = other DNA
  modified_base order(13,23..24): mod_base = OTHER; note = 2 prime-4 prime methylene bridge nucleoside
  modified_base order(1..2,12): mod_base = OTHER; note = 2 prime-4 prime methylene bridge-5-methylcytidine
  modified_base order(3,5..8,10..11,14..22): mod_base = OTHER; note = 2 prime-O-methoxyethyl nucleoside
  modified_base order(4,9): mod_base = OTHER; note = 2 prime-O-methoxyethyl-5-methylcytidine
  modified_base 1..24: mod_base = OTHER; note = phosphorothioate linkage
ccacgaatctacggggataagagt

SEQ ID NO: 1006 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base order(1^2,4..26): mod_base = OTHER; note = phosphorothioate linkage
ccacgaatctaccggggataagagtt

SEQ ID NO: 1007 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base order(1..11,13..26): mod_base = OTHER; note = phosphorothioate linkage
ccacgaatctaccggggataagagtt

SEQ ID NO: 1008 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base order(1..15,17..26): mod_base = OTHER; note = phosphorothioate linkage
ccacgaatctaccggggataagagtt

SEQ ID NO: 1009 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base order(1..23,25^26): mod_base = OTHER; note = phosphorothioate linkage
ccacgaatctaccggggataagagtt

SEQ ID NO: 1010 - DNA, 26 bp, synthetic construct
  source 1..26: mol_type = other DNA
  modified_base order(3,5..8,10..11,14..26): mod_base = OTHER; note = 2 prime-O-methoxyethyl nucleoside
  modified_base order(1..2,4,9,12..13): mod_base = OTHER; note = 2 prime-O-methoxyethyl-5-methylcytidine
  modified_base order(1..20,25^26): mod_base = OTHER; note = phosphorothioate linkage
ccacgaatctaccggggataagagtt

SEQ ID NO: 1011 - DNA, 26 bp, synthetic construct
  source 1..26: mol_type = other DNA
  modified_base order(1,3..6,8..9,13..26): mod_base = OTHER; note = 2 prime-O-methoxyethyl nucleoside
  modified_base order(2,7,10..12): mod_base = OTHER; note = 2 prime-O-methoxyethyl-5-methylcytidine
  modified_base 1..26: mod_base = OTHER; note = phosphorothioate linkage
acgaatctacccaggggataagagtt

SEQ ID NO: 1012 - DNA, 26 bp, synthetic construct
  source 1..26: mol_type = other DNA
  modified_base order(2..4,7,9..12,14..21,23..25): mod_base = OTHER; note = 2 prime-O-methoxyethyl nucleoside
  modified_base order(1,5..6,8,13,22,26): mod_base = OTHER; note = 2 prime-O-methoxyethyl-5-methylcytidine
  modified_base 1..26: mod_base = OTHER; note = phosphorothioate linkage
ctagccacgaatctaagagttctttc

SEQ ID NO: 1013 - DNA, 26 bp, synthetic construct
  source 1..26: mol_type = other DNA
  modified_base order(3,5..8,10..11,14..22,24..26): mod_base = OTHER; note = 2 prime-O-methoxyethyl nucleoside
  modified_base order(1..2,4,9,12..13,23): mod_base = OTHER; note = 2 prime-O-methoxyethyl-5-methylcytidine
  modified_base 1..26: mod_base = OTHER; note = phosphorothioate linkage
ccacgaatctaccataagagttcttt

SEQ ID NO: 1014 - DNA, 26 bp, synthetic construct
  source 1..26: mol_type = other DNA
  modified_base 11: mod_base = OTHER; note = 2 prime-4 prime methylene bridge nucleoside
  modified_base 12: mod_base = OTHER; note = 2 prime-4 prime methylene bridge-5-methylcytidine
  modified_base order(3..4,7..8,10,14..24): mod_base = OTHER; note = 2 prime-O-methoxyethyl nucleoside
  modified_base order(1..2,5..6,9,13,25..26): mod_base = OTHER; note = 2 prime-O-methoxyethyl-5-methylcytidine
  modified_base order(1..11,13..26): mod_base = OTHER; note = phosphorothioate linkage
ccatccatcatccgggataagagtcc

SEQ ID NO: 1015 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base order(1^2,4..26): mod_base = OTHER; note = phosphorothioate linkage
tccatccatcatcggggataagagtt

SEQ ID NO: 1016 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base order(1..11,13..26): mod_base = OTHER; note = phosphorothioate linkage
tccatccatcatcggggataagagtt

SEQ ID NO: 1017 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base order(1..15,17..26): mod_base = OTHER; note = phosphorothioate linkage
tccatccatcatcggggataagagtt

SEQ ID NO: 1018 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base order(1..23,25^26): mod_base = OTHER; note = phosphorothioate linkage
tccatccatcatcggggataagagtt

SEQ ID NO: 1019 - DNA, 26 bp, synthetic construct
  source 1..26: mol_type = other DNA
  modified_base order(1,4..5,8..9,11..12,14..26): mod_base = OTHER; note = 2 prime-O-methoxyethyl nucleoside
  modified_base order(2..3,6..7,10,13): mod_base = OTHER; note = 2 prime-O-methoxyethyl-5-methylcytidine
  modified_base order(1..20,25^26): mod_base = OTHER; note = phosphorothioate linkage
tccatccatcatcggggataagagtt

SEQ ID NO: 1020 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base order(1^2,4..26): mod_base = OTHER; note = phosphorothioate linkage
tccatccatcatcgggataagagttc

SEQ ID NO: 1021 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base order(1..11,13..26): mod_base = OTHER; note = phosphorothioate linkage
tccatccatcatcgggataagagttc

SEQ ID NO: 1022 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base order(1..15,17..26): mod_base = OTHER; note = phosphorothioate linkage
tccatccatcatcgggataagagttc

SEQ ID NO: 1023 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base order(1..23,25^26): mod_base = OTHER; note = phosphorothioate linkage
tccatccatcatcgggataagagttc

SEQ ID NO: 1024 - DNA, 26 bp, synthetic construct
  source 1..26: mol_type = other DNA
  modified_base order(1,4..5,8..9,11..12,14..25): mod_base = OTHER; note = 2 prime-O-methoxyethyl nucleoside
  modified_base order(2..3,6..7,10,13,26): mod_base = OTHER; note = 2 prime-O-methoxyethyl-5-methylcytidine
  modified_base order(1..20,25^26): mod_base = OTHER; note = phosphorothioate linkage
tccatccatcatcgggataagagttc

SEQ ID NO: 1025 - DNA, 26 bp, synthetic construct
  source 1..26: mol_type = other DNA
  modified_base order(1,4..5,8..9,11..12,14..24,26): mod_base = OTHER; note = 2 prime-O-methoxyethyl nucleoside
  modified_base order(2..3,6..7,10,13,25): mod_base = OTHER; note = 2 prime-O-methoxyethyl-5-methylcytidine
  modified_base order(1..20,25^26): mod_base = OTHER; note = phosphorothioate linkage
tccatccatcatcggataagagttct

SEQ ID NO: 1026 - DNA, 26 bp, synthetic construct
  source 1..26: mol_type = other DNA
  modified_base order(3..4,7..8,10..11,14..23,25..26): mod_base = OTHER; note = 2 prime-O-methoxyethyl nucleoside
  modified_base order(1..2,5..6,9,12..13,24): mod_base = OTHER; note = 2 prime-O-methoxyethyl-5-methylcytidine
  modified_base order(1^2,4..26): mod_base = OTHER; note = phosphorothioate linkage
ccatccatcatccgataagagttctt

SEQ ID NO: 1027 - DNA, 26 bp, synthetic construct
  source 1..26: mol_type = other DNA
  modified_base order(3..4,7..8,10..11,14..23,25..26): mod_base = OTHER; note = 2 prime-O-methoxyethyl nucleoside
  modified_base order(1..2,5..6,9,12..13,24): mod_base = OTHER; note = 2 prime-O-methoxyethyl-5-methylcytidine
  modified_base order(1..15,17..26): mod_base = OTHER; note = phosphorothioate linkage
ccatccatcatccgataagagttctt

SEQ ID NO: 1028 - DNA, 26 bp, synthetic construct
  source 1..26: mol_type = other DNA
  modified_base order(3..4,7..8,10..11,14..23,25..26): mod_base = OTHER; note = 2 prime-O-methoxyethyl nucleoside
  modified_base order(1..2,5..6,9,12..13,24): mod_base = OTHER; note = 2 prime-O-methoxyethyl-5-methylcytidine
  modified_base order(1..23,25^26): mod_base = OTHER; note = phosphorothioate linkage
ccatccatcatccgataagagttctt

SEQ ID NO: 1029 - DNA, 26 bp, synthetic construct
  source 1..26: mol_type = other DNA
  modified_base order(3..4,7..8,10..11,14..23,25..26): mod_base = OTHER; note = 2 prime-O-methoxyethyl nucleoside
  modified_base order(1..2,5..6,9,12..13,24): mod_base = OTHER; note = 2 prime-O-methoxyethyl-5-methylcytidine
  modified_base order(1..20,25^26): mod_base = OTHER; note = phosphorothioate linkage
ccatccatcatccgataagagttctt

SEQ ID NO: 1030 - DNA, 24 bp, synthetic construct
  source 1..24: mol_type = other DNA
  modified_base order(3..4,7..8,10..11,13..24): mod_base = OTHER; note = 2 prime-O-methoxyethyl nucleoside
  modified_base order(1..2,5..6,9,12): mod_base = OTHER; note = 2 prime-O-methoxyethyl-5-methylcytidine
  modified_base 1..24: mod_base = OTHER; note = phosphorothioate linkage
ccatccatcatcggggataagagt

SEQ ID NO: 1031 - DNA, 24 bp, synthetic construct
  source 1..24: mol_type = other DNA
  modified_base order(13,23..24): mod_base = OTHER; note = 2 prime-4 prime methylene bridge nucleoside
  modified_base order(1..2,12): mod_base = OTHER; note = 2 prime-4 prime methylene bridge-5-methylcytidine
  modified_base order(3..4,7..8,10..11,14..22): mod_base = OTHER; note = 2 prime-O-methoxyethyl nucleoside
  modified_base order(5..6,9): mod_base = OTHER; note = 2 prime-O-methoxyethyl-5-methylcytidine
  modified_base 1..24: mod_base = OTHER; note = phosphorothioate linkage
ccatccatcatcggggataagagt

SEQ ID NO: 1032 - DNA, 24 bp, synthetic construct
  source 1..24: mol_type = other DNA
  modified_base order(13,23): mod_base = OTHER; note = 2 prime-4 prime methylene bridge nucleoside
  modified_base order(1..2,12,24): mod_base = OTHER; note = 2 prime-4 prime methylene bridge-5-methylcytidine
  modified_base order(3..4,7..8,10..11,14..22): mod_base = OTHER; note = 2 prime-O-methoxyethyl nucleoside
  modified_base order(5..6,9): mod_base = OTHER; note = 2 prime-O-methoxyethyl-5-methylcytidine
  modified_base 1..24: mod_base = OTHER; note = phosphorothioate linkage
ccatccatcatcggataagagttc

SEQ ID NO: 1033 - DNA, 26 bp, synthetic construct
  source 1..26: mol_type = other DNA
  modified_base order(1,3..4,7..8,10..12,14..25): mod_base = OTHER; note = 2 prime-O-methoxyethyl nucleoside
  modified_base order(2,5..6,9,13,26): mod_base = OTHER; note = 2 prime-O-methoxyethyl-5-methylcytidine
  modified_base 1..26: mod_base = OTHER; note = phosphorothioate linkage
tcatccatctagcgggataagagttc

SEQ ID NO: 1034 - DNA, 26 bp, synthetic construct
  source 1..26: mol_type = other DNA
  modified_base order(2..3,6..7,9..11,14..25): mod_base = OTHER; note = 2 prime-O-methoxyethyl nucleoside
  modified_base order(1,4..5,8,12..13,26): mod_base = OTHER; note = 2 prime-O-methoxyethyl-5-methylcytidine
  modified_base 1..26: mod_base = OTHER; note = phosphorothioate linkage
catccatctagccgggataagagttc

SEQ ID NO: 1035 - DNA, 26 bp, synthetic construct
  source 1..26: mol_type = other DNA
  modified_base order(1,4..5,7..9,12,14..26): mod_base = OTHER; note = 2 prime-O-methoxyethyl nucleoside
  modified_base order(2..3,6,10..11,13): mod_base = OTHER; note = 2 prime-O-methoxyethyl-5-methylcytidine
  modified_base 1..26: mod_base = OTHER; note = phosphorothioate linkage
tccatctagccacggggataagagtt

SEQ ID NO: 1036 - DNA, 24 bp, synthetic construct
  source 1..24: mol_type = other DNA
  modified_base order(1..2,5..6,8..10,13..24): mod_base = OTHER; note = 2 prime-O-methoxyethyl nucleoside
  modified_base order(3..4,7,11..12): mod_base = OTHER; note = 2 prime-O-methoxyethyl-5-methylcytidine
  modified_base 1..24: mod_base = OTHER; note = phosphorothioate linkage
atccatctagccgggataagagtt

SEQ ID NO: 1037 - DNA, 24 bp, synthetic construct
  source 1..24: mol_type = other DNA
  modified_base order(1..2,5..6,8..10,13..24): mod_base = OTHER; note = 2 prime-O-methoxyethyl nucleoside
  modified_base order(3..4,7,11..12): mod_base = OTHER; note = 2 prime-O-methoxyethyl-5-methylcytidine
  modified_base 1..24: mod_base = OTHER; note = phosphorothioate linkage
atccatctagccggggataagagt

SEQ ID NO: 1038 - DNA, 26 bp, synthetic construct
  source 1..26: mol_type = other DNA
  modified_base order(3..4,7..8,10..11,14..26): mod_base = OTHER; note = 2 prime-O-methoxyethyl nucleoside
  modified_base order(1..2,5..6,9,12..13): mod_base = OTHER; note = 2 prime-O-methoxyethyl-5-methylcytidine
  modified_base 1..26: mod_base = OTHER; note = phosphorothioate linkage
ccatccatcatccggggataagagtt

SEQ ID NO: 1039 - DNA, 26 bp, synthetic construct
  source 1..26: mol_type = other DNA
  modified_base order(1..6,9..10,13,15..19,22..26): mod_base = OTHER; note = 2 prime-O-methoxyethyl nucleoside
  modified_base order(7..8,11..12,14,20..21): mod_base = OTHER; note = 2 prime-O-methoxyethyl-5-methylcytidine
  modified_base 1..26: mod_base = OTHER; note = phosphorothioate linkage
atatatccatccactagttcctgggg

SEQ ID NO: 1040 - DNA, 13 bp, synthetic construct
  source 1..13: mol_type = other DNA
  modified_base order(1..6,9..10,13): mod_base = OTHER; note = 2 prime-O-methoxyethyl nucleoside
  modified_base order(7..8,11..12): mod_base = OTHER; note = 2 prime-O-methoxyethyl-5-methylcytidine
  modified_base 1..13: mod_base = OTHER; note = phosphorothioate linkage
atatatccatcca

SEQ ID NO: 1041 - DNA, 13 bp, synthetic construct
  source 1..13: mol_type = other DNA
  modified_base order(2..6,9..13): mod_base = OTHER; note = 2 prime-O-methoxyethyl nucleoside
  modified_base order(1,7..8): mod_base = OTHER; note = 2 prime-O-methoxyethyl-5-methylcytidine
  modified_base 2..13: mod_base = OTHER; note = phosphorothioate linkage
ctagttcctgggg

SEQ ID NO: 1042 - DNA, 26 bp, synthetic construct
  source 1..26: mol_type = other DNA
  modified_base order(13,15): mod_base = OTHER; note = 2 prime-4 prime methylene bridge nucleoside
  modified_base order(12,14): mod_base = OTHER; note = 2 prime-4 prime methylene bridge-5-methylcytidine
  modified_base order(1..6,9..10,16..19,22..26): mod_base = OTHER; note = 2 prime-O-methoxyethyl nucleoside
  modified_base order(7..8,11,20..21): mod_base = OTHER; note = 2 prime-O-methoxyethyl-5-methylcytidine
  modified_base 1..26: mod_base = OTHER; note = phosphorothioate linkage
atatatccatccactagttcctgggg

SEQ ID NO: 1043 - DNA, 26 bp, synthetic construct
  source 1..26: mol_type = other DNA
  modified_base order(1..5,7..9,11..19,21..23,26): mod_base = OTHER; note = 2 prime-O-methoxyethyl nucleoside
  modified_base order(6,10,20,24..25): mod_base = OTHER; note = 2 prime-O-methoxyethyl-5-methylcytidine
  modified_base 1..26: mod_base = OTHER; note = phosphorothioate linkage
tagttcaatcataagagttctttcca

SEQ ID NO: 1044 - DNA, 20 bp, synthetic construct
  source 1..20: mol_type = other DNA
  modified_base order(1,19..20): mod_base = OTHER; note = 2 prime-4 prime methylene bridge nucleoside
  modified_base 2: mod_base = OTHER; note = 2 prime-4 prime methylene bridge-5-methylcytidine
  modified_base order(3..4,6..9,11..12,14..16,18): mod_base = OTHER; note = 2 prime-O-methoxyethyl nucleoside
  modified_base order(5,10,13,17): mod_base = OTHER; note = 2 prime-O-methoxyethyl-5-methylcytidine
  modified_base 1..20: mod_base = OTHER; note = phosphorothioate linkage
tcatctgttcaacaaactag

SEQ ID NO: 1045 - DNA, 26 bp, synthetic construct
  source 1..26: mol_type = other DNA
  modified_base order(1..2,4..7,9..11,13..14,16..22,24..25): mod_base = OTHER; note = 2 prime-O-methoxyethyl nucleoside
  modified_base order(3,8,12,15,23,26): mod_base = OTHER; note = 2 prime-O-methoxyethyl-5-methylcytidine
  modified_base 1..26: mod_base = OTHER; note = phosphorothioate linkage
atctgttcaatcagcatttattcaac

SEQ ID NO: 1046 - DNA, 20 bp, synthetic construct
  source 1..20: mol_type = other DNA
  modified_base order(1..2,19..20): mod_base = OTHER; note = 2 prime-4 prime methylene bridge nucleoside
  modified_base order(4..5,9,12..13,15..18): mod_base = OTHER; note = 2 prime-O-methoxyethyl nucleoside
  modified_base order(3,6..8,10..11,14): mod_base = OTHER; note = 2 prime-O-methoxyethyl-5-methylcytidine
  modified_base 1..20: mod_base = OTHER; note = phosphorothioate linkage
atctacccaccagcatttat

SEQ ID NO: 1047 - DNA, 26 bp, synthetic construct
  source 1..26: mol_type = other DNA
  modified_base order(3,5..8,10..11,14..16,18..20,22..24,26): mod_base = OTHER; note = 2 prime-O-methoxyethyl nucleoside
  modified_base order(1..2,4,9,12..13,17,21,25): mod_base = OTHER; note = 2 prime-O-methoxyethyl-5-methylcytidine
  modified_base 1..26: mod_base = OTHER; note = phosphorothioate linkage
ccacgaatctaccgttcaatcattca

SEQ ID NO: 1048 - DNA, 26 bp, synthetic construct
  source 1..26: mol_type = other DNA
  modified_base order(2,4..7,9..10,14..16,18,21..22,24..26): mod_base = OTHER; note = 2 prime-O-methoxyethyl nucleoside
  modified_base order(1,3,8,11..13,17,19..20,23): mod_base = OTHER; note = 2 prime-O-methoxyethyl-5-methylcytidine
  modified_base 1..26: mod_base = OTHER; note = phosphorothioate linkage
cacgaatctacccattcaccagcatt

SEQ ID NO: 1049 - DNA, 26 bp, synthetic construct
  source 1..26: mol_type = other DNA
  modified_base order(1,3..6,8..9,13..16,18..20,22..24,26): mod_base = OTHER; note = 2 prime-O-methoxyethyl nucleoside
  modified_base order(2,7,10..12,17,21,25): mod_base = OTHER; note = 2 prime-O-methoxyethyl-5-methylcytidine
  modified_base 1..26: mod_base = OTHER; note = phosphorothioate linkage
acgaatctacccagttcaatcattca

SEQ ID NO: 1050 - DNA, 26 bp, synthetic construct
  source 1..26: mol_type = other DNA
  modified_base order(3,5..8,10..11,14..16,18..20,22..24,26): mod_base = OTHER; note = 2 prime-O-methoxyethyl nucleoside
  modified_base order(1..2,4,9,12..13,17,21,25): mod_base = OTHER; note = 2 prime-O-methoxyethyl-5-methylcytidine
  modified_base order(1^2,5..20): mod_base = OTHER; note = phosphorothioate linkage
ccacgaatctaccgttcaatcattca

SEQ ID NO: 1051 - DNA, 26 bp, synthetic construct
  source 1..26: mol_type = other DNA
  modified_base order(3,5..8,10..11,14..16,18..20,22..24,26): mod_base = OTHER; note = 2 prime-O-methoxyethyl nucleoside
  modified_base order(1..2,4,9,12..13,17,21,25): mod_base = OTHER; note = 2 prime-O-methoxyethyl-5-methylcytidine
  modified_base order(1..22,25^26): mod_base = OTHER; note = phosphorothioate linkage
ccacgaatctaccgttcaatcattca

SEQ ID NO: 1052 - DNA, 26 bp, synthetic construct
  source 1..26: mol_type = other DNA
  modified_base order(2,4..7,9..10,14..16,18,21..22,24..26): mod_base = OTHER; note = 2 prime-O-methoxyethyl nucleoside
  modified_base order(1,3,8,11..13,17,19..20,23): mod_base = OTHER; note = 2 prime-O-methoxyethyl-5-methylcytidine
  modified_base order(1^2,5..20): mod_base = OTHER; note = phosphorothioate linkage
cacgaatctacccattcaccagcatt

SEQ ID NO: 1053 - DNA, 26 bp, synthetic construct
  source 1..26: mol_type = other DNA
  modified_base order(2,4..7,9..10,14..16,18,21..22,24..26): mod_base = OTHER; note = 2 prime-O-methoxyethyl nucleoside
  modified_base order(1,3,8,11..13,17,19..20,23): mod_base = OTHER; note = 2 prime-O-methoxyethyl-5-methylcytidine
  modified_base order(1..22,25^26): mod_base = OTHER; note = phosphorothioate linkage
cacgaatctacccattcaccagcatt

SEQ ID NO: 1054 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..4,7..11,13,15..17,19): mod_base = OTHER; note = 2 prime-O-methoxyethyl nucleoside
  modified_base order(2,5..6,12,14,18): mod_base = OTHER; note = 2 prime-O-methoxyethyl-5-methylcytidine
  modified_base 1..20: mod_base = OTHER; note = phosphorothioate linkage
ccatccatgtactcaatcat

SEQ ID NO: 1055 - DNA, 22 bp, synthetic construct
  source 1..22: mol_type = other DNA
  modified_base 1..22: mod_base = OTHER; note = phosphorothioate linkage
  modified_base 22: mod_base = OTHER; note = 2 prime-4 prime methylene bridge-5-methylcytidine
  modified_base order(3..4,6..7,14..17,19..20): mod_base = OTHER; note = 2 prime-O-methoxyethyl nucleoside
  modified_base order(5,8..9,18): mod_base = OTHER; note = 2 prime-O-methoxyethyl-5-methylcytidine
  modified_base order(1..2,11..12,21): mod_base = OTHER; note = amido-bridge nucleoside
  modified_base order(10,13): mod_base = OTHER; note = amido-bridge-5-methylcytidine
gaatctacccatctgttcaatc

SEQ ID NO: 1056 - DNA, 24 bp, synthetic construct
  source 1..24: mol_type = other DNA
  modified_base 1..24: mod_base = OTHER; note = phosphorothioate linkage
  modified_base 24: mod_base = OTHER; note = 2 prime-4 prime methylene bridge-5-methylcytidine
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(2..4,12..14,21..23): mod_base = OTHER; note = amido-bridge nucleoside
  modified_base order(1,11): mod_base = OTHER; note = amido-bridge-5-methylcytidine
cgaatctacccaatctgttcaatc

SEQ ID NO: 1057 - DNA, 26 bp, synthetic construct
  source 1..26: mol_type = other DNA
  modified_base order(2,26): mod_base = OTHER; note = 2 prime-4 prime methylene bridge nucleoside
  modified_base order(1,25): mod_base = OTHER; note = 2 prime-4 prime methylene bridge-5-methylcytidine
  modified_base order(3..5,7..8,12,14..15,17..20,22..24): mod_base = OTHER; note = 2 prime-O-methoxyethyl nucleoside
  modified_base order(6,9..11,13,16,21): mod_base = OTHER; note = 2 prime-O-methoxyethyl-5-methylcytidine
  modified_base 1..26: mod_base = OTHER; note = phosphorothioate linkage
cgaatctacccacatctgttcaatca

SEQ ID NO: 1058 - DNA, 26 bp, synthetic construct
  source 1..26: mol_type = other DNA
  modified_base 2..3: mod_base = OTHER; note = 2 prime-4 prime methylene bridge nucleoside
  modified_base order(4..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,4..26): mod_base = OTHER; note = phosphorothioate linkage
cgaatctacccacatctgttcaatca

SEQ ID NO: 1059 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1..20,25^26): mod_base = OTHER; note = phosphorothioate linkage
acgaatctacccacatctgttcaatc

SEQ ID NO: 1060 - DNA, 24 bp, synthetic construct
  source 1..24: mol_type = other DNA
  modified_base order(2..5,7..8,12,14..15,17..20,22..24): mod_base = OTHER; note = 2 prime-O-methoxyethyl nucleoside
  modified_base order(1,6,9..11,13,16,21): mod_base = OTHER; note = 2 prime-O-methoxyethyl-5-methylcytidine
  modified_base 1..24: mod_base = OTHER; note = phosphorothioate linkage
cgaatctacccacatctgttcaat

SEQ ID NO: 1061 - DNA, 24 bp, synthetic construct
  source 1..24: mol_type = other DNA
  modified_base order(1,3..6,8..9,13..14,16..19,21..23): mod_base = OTHER; note = 2 prime-O-methoxyethyl nucleoside
  modified_base order(2,7,10..12,15,20,24): mod_base = OTHER; note = 2 prime-O-methoxyethyl-5-methylcytidine
  modified_base 1..24: mod_base = OTHER; note = phosphorothioate linkage
acgaatctacccatctgttcaatc

SEQ ID NO: 1062 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1^2,4..26): mod_base = OTHER; note = phosphorothioate linkage
acgaatctacccacatctgttcaatc

SEQ ID NO: 1063 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1..11,13..26): mod_base = OTHER; note = phosphorothioate linkage
acgaatctacccacatctgttcaatc

SEQ ID NO: 1064 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1..15,17..26): mod_base = OTHER; note = phosphorothioate linkage
acgaatctacccacatctgttcaatc

SEQ ID NO: 1065 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1..23,25^26): mod_base = OTHER; note = phosphorothioate linkage
acgaatctacccacatctgttcaatc

SEQ ID NO: 1066 - DNA, 24 bp, synthetic construct
  source 1..24: mol_type = other DNA
  modified_base order(2,12..13,23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(3..5,7..8,14,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1^2,4..24): mod_base = OTHER; note = phosphorothioate linkage
cgaatctacccaatctgttcaatc

SEQ ID NO: 1067 - DNA, 24 bp, synthetic construct
  source 1..24: mol_type = other DNA
  modified_base order(2,12..13,23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(3..5,7..8,14,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1068 - DNA, 24 bp, synthetic construct
  source 1..24: mol_type = other DNA
  modified_base order(2,12..13,23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(3..5,7..8,14,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1..14,16..24): mod_base = OTHER; note = phosphorothioate linkage
cgaatctacccaatctgttcaatc

SEQ ID NO: 1069 - DNA, 24 bp, synthetic construct
  source 1..24: mol_type = other DNA
  modified_base order(2,12..13,23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(3..5,7..8,14,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1..21,23^24): mod_base = OTHER; note = phosphorothioate linkage
cgaatctacccaatctgttcaatc

SEQ ID NO: 1070 - DNA, 24 bp, synthetic construct
  source 1..24: mol_type = other DNA
  modified_base order(2,24): mod_base = OTHER; note = 2 prime-4 prime methylene bridge nucleoside
  modified_base order(1,13..14,23): mod_base = OTHER; note = 2 prime-4 prime methylene bridge-5-methylcytidine
  modified_base order(3..5,7..8,12,15..18,20..22): mod_base = OTHER; note = 2 prime-O-methoxyethyl nucleoside
  modified_base order(6,9..11,19): mod_base = OTHER; note = 2 prime-O-methoxyethyl-5-methylcytidine
  modified_base 1..24: mod_base = OTHER; note = phosphorothioate linkage
cgaatctacccacctgttcaatca

SEQ ID NO: 1071 - DNA, 24 bp, synthetic construct
  source 1..24: mol_type = other DNA
  modified_base order(2,14,23..24): mod_base = OTHER; note = 2 prime-4 prime methylene bridge nucleoside
  modified_base order(1,13): mod_base = OTHER; note = 2 prime-4 prime methylene bridge-5-methylcytidine
  modified_base order(3..5,7..8,12,15,17..20,22): mod_base = OTHER; note = 2 prime-O-methoxyethyl nucleoside
  modified_base order(6,9..11,16,21): mod_base = OTHER; note = 2 prime-O-methoxyethyl-5-methylcytidine
  modified_base 1..24: mod_base = OTHER; note = phosphorothioate linkage
cgaatctacccacatctgttcaat

SEQ ID NO: 1072 - DNA, 24 bp, synthetic construct
  source 1..24: mol_type = other DNA
  modified_base order(2,14,23): mod_base = OTHER; note = 2 prime-4 prime methylene bridge nucleoside
  modified_base order(1,13,24): mod_base = OTHER; note = 2 prime-4 prime methylene bridge-5-methylcytidine
  modified_base order(3..5,7..8,12,16..19,21..22): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base 1..24: mod_base = OTHER; note = phosphorothioate linkage
cgaatctacccactctgttcaatc

SEQ ID NO: 1073 - DNA, 25 bp, synthetic construct
  source 1..25: mol_type = other DNA
  modified_base order(2..5,7..8,12..14,16..19,21..23,25): mod_base = OTHER; note = 2 prime-O-methoxyethyl nucleoside
  modified_base order(1,6,9..11,15,20,24): mod_base = OTHER; note = 2 prime-O-methoxyethyl-5-methylcytidine
  modified_base 1..25: mod_base = OTHER; note = phosphorothioate linkage
cgaatctacccaatctgttcaatca

SEQ ID NO: 1074 - DNA, 25 bp, synthetic construct
  source 1..25: mol_type = other DNA
  modified_base order(2..5,7..8,12,14,16..19,21..23,25): mod_base = OTHER; note = 2 prime-O-methoxyethyl nucleoside
  modified_base order(1,6,9..11,13,15,20,24): mod_base = OTHER; note = 2 prime-O-methoxyethyl-5-methylcytidine
  modified_base 1..25: mod_base = OTHER; note = phosphorothioate linkage
cgaatctacccactctgttcaatca

SEQ ID NO: 1075 - DNA, 25 bp, synthetic construct
  source 1..25: mol_type = other DNA
  modified_base order(1,3..6,8..9,14..15,17..20,22..24): mod_base = OTHER; note = 2 prime-O-methoxyethyl nucleoside
  modified_base order(2,7,10..13,16,21,25): mod_base = OTHER; note = 2 prime-O-methoxyethyl-5-methylcytidine
  modified_base 1..25: mod_base = OTHER; note = phosphorothioate linkage
acgaatctaccccatctgttcaatc

SEQ ID NO: 1076 - DNA, 25 bp, synthetic construct
  source 1..25: mol_type = other DNA
  modified_base order(1,3..6,8..9,13..15,17..20,22..24): mod_base = OTHER; note = 2 prime-O-methoxyethyl nucleoside
  modified_base order(2,7,10..12,16,21,25): mod_base = OTHER; note = 2 prime-O-methoxyethyl-5-methylcytidine
  modified_base 1..25: mod_base = OTHER; note = phosphorothioate linkage
acgaatctacccaatctgttcaatc

SEQ ID NO: 1077 - DNA, 26 bp, synthetic construct
  source 1..26: mol_type = other DNA
  modified_base order(2,4..7,9..10,14..17,19..21,23..25): mod_base = OTHER; note = 2 prime-O-methoxyethyl nucleoside
  modified_base order(1,3,8,11..13,18,22,26): mod_base = OTHER; note = 2 prime-O-methoxyethyl-5-methylcytidine
  modified_base 1..26: mod_base = OTHER; note = phosphorothioate linkage
cacgaatctaccctgttcaatcattc

SEQ ID NO: 1078 - DNA, 26 bp, synthetic construct
  source 1..26: mol_type = other DNA
  modified_base order(1,3..6,8..9,13..17,19..21,23..25): mod_base = OTHER; note = 2 prime-O-methoxyethyl nucleoside
  modified_base order(2,7,10..12,18,22,26): mod_base = OTHER; note = 2 prime-O-methoxyethyl-5-methylcytidine
  modified_base 1..26: mod_base = OTHER; note = phosphorothioate linkage
acgaatctacccatgttcaatcattc

SEQ ID NO: 1079 - DNA, 26 bp, synthetic construct
  source 1..26: mol_type = other DNA
  modified_base order(3,5..8,10..11,15..18,20..22,24..26): mod_base = OTHER; note = 2 prime-O-methoxyethyl nucleoside
  modified_base order(1..2,4,9,12..14,19,23): mod_base = OTHER; note = 2 prime-O-methoxyethyl-5-methylcytidine
  modified_base 1..26: mod_base = OTHER; note = phosphorothioate linkage
ccacgaatctaccctgttcaatcatt

SEQ ID NO: 1080 - DNA, 26 bp, synthetic construct
  source 1..26: mol_type = other DNA
  modified_base order(1,3..6,8..9,13,15..18,20..22,24..26): mod_base = OTHER; note = 2 prime-O-methoxyethyl nucleoside
  modified_base order(2,7,10..12,14,19,23): mod_base = OTHER; note = 2 prime-O-methoxyethyl-5-methylcytidine
  modified_base 1..26: mod_base = OTHER; note = phosphorothioate linkage
acgaatctacccactgttcaatcatt

SEQ ID NO: 1081 - DNA, 26 bp, synthetic construct
  source 1..26: mol_type = other DNA
  modified_base order(3,5..8,10..11,15..16,18..21,23..25): mod_base = OTHER; note = 2 prime-O-methoxyethyl nucleoside
  modified_base order(1..2,4,9,12..14,17,22,26): mod_base = OTHER; note = 2 prime-O-methoxyethyl-5-methylcytidine
  modified_base 1..26: mod_base = OTHER; note = phosphorothioate linkage
ccacgaatctacccatctgttcaatc

SEQ ID NO: 1082 - DNA, 24 bp, synthetic construct
  source 1..24: mol_type = other DNA
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..9,11..24): mod_base = OTHER; note = phosphorothioate linkage
cgaatctacccaatctgttcaatc

SEQ ID NO: 1083 - DNA, 24 bp, synthetic construct
  source 1..24: mol_type = other DNA
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..11,13..24): mod_base = OTHER; note = phosphorothioate linkage
cgaatctacccaatctgttcaatc

SEQ ID NO: 1084 - DNA, 24 bp, synthetic construct
  source 1..24: mol_type = other DNA
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..9,12..24): mod_base = OTHER; note = phosphorothioate linkage
cgaatctacccaatctgttcaatc

SEQ ID NO: 1085 - DNA, 24 bp, synthetic construct
  source 1..24: mol_type = other DNA
  modified_base order(2..4,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..10,13..24): mod_base = OTHER; note = phosphorothioate linkage
cgaatctacccaatctgttcaatc

SEQ ID NO: 1086 - DNA, 24 bp, synthetic construct
  source 1..24: mol_type = other DNA
  modified_base order(2,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(3..5,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1087 - DNA, 24 bp, synthetic construct
  source 1..24: mol_type = other DNA
  modified_base order(2..4,12..14,23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(5,7..8,16..19,21..22): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1088 - DNA, 24 bp, synthetic construct
  source 1..24: mol_type = other DNA
  modified_base order(2..4,12..13,21..23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(5,7..8,14,16..19): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1089 - DNA, 24 bp, synthetic construct
  source 1..24: mol_type = other DNA
  modified_base order(2..3,12..14,22..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(4..5,7..8,16..19,21): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1090 - DNA, 24 bp, synthetic construct
  source 1..24: mol_type = other DNA
  modified_base order(2..3,12..13,22..23): mod_base = OTHER; note = 2 prime-4 prime methylene bridge nucleoside
  modified_base order(1,24): mod_base = OTHER; note = 2 prime-4 prime methylene bridge-5-methylcytidine
  modified_base order(4..5,7..8,14,16..19,21): mod_base = OTHER; note = 2 prime-O-methoxyethyl nucleoside
  modified_base order(6,9..11,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1091 - DNA, 24 bp, synthetic construct
  source 1..24: mol_type = other DNA
  modified_base order(2,4..5,12..14,21..23): mod_base = OTHER; note = 2 prime-4 prime methylene bridge nucleoside
  modified_base order(1,11,24): mod_base = OTHER; note = 2 prime-4 prime methylene bridge-5-methylcytidine
  modified_base order(3,7..8,16..19): mod_base = OTHER; note = 2 prime-O-methoxyethyl nucleoside
  modified_base order(6,9..10,15,20): mod_base = OTHER; note = 2 prime-O-methoxyethyl-5-methylcytidine
  modified_base order(1..10,12..24): mod_base = OTHER; note = phosphorothioate linkage
cgaatctacccaatctgttcaatc

SEQ ID NO: 1092 - DNA, 20 bp, synthetic construct
  source 1..20: mol_type = other DNA
  modified_base order(1..2,19): mod_base = OTHER; note = 2 prime-4 prime methylene bridge nucleoside
  modified_base 20: mod_base = OTHER; note = 2 prime-4 prime methylene bridge-5-methylcytidine
  modified_base order(5,7..10,12..15,17..18): mod_base = OTHER; note = 2 prime-O-methoxyethyl nucleoside
  modified_base order(3..4,6,11,16): mod_base = OTHER; note = 2 prime-O-methoxyethyl-5-methylcytidine
  modified_base 1..20: mod_base = OTHER; note = phosphorothioate linkage
agccacgaatctgttcaatc

SEQ ID NO: 1093 - DNA, 20 bp, synthetic construct
  source 1..20: mol_type = other DNA
  modified_base 19..20: mod_base = OTHER; note = 2 prime-4 prime methylene bridge nucleoside
  modified_base 1..2: mod_base = OTHER; note = 2 prime-4 prime methylene bridge-5-methylcytidine
  modified_base order(3,6..7,9,11..13,15..16,18): mod_base = OTHER; note = 2 prime-O-methoxyethyl nucleoside
  modified_base order(4..5,8,10,14,17): mod_base = OTHER; note = 2 prime-O-methoxyethyl-5-methylcytidine
  modified_base 1..20: mod_base = OTHER; note = phosphorothioate linkage
ccaccaactcattcatctgt

SEQ ID NO: 1094 - DNA, 26 bp, synthetic construct
  source 1..26: mol_type = other DNA
  modified_base 2: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..5,7..8,12,14..15,17..20,22..24,26): mod_base = OTHER; note = 2 prime-O-methoxyethyl nucleoside
  modified_base order(6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1095 - DNA, 26 bp, synthetic construct
  source 1..26: mol_type = other DNA
  modified_base 3..4: mod_base = OTHER; note = 2 prime-4 prime methylene bridge nucleoside
  modified_base order(2,5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1096 - DNA, 26 bp, synthetic construct
  source 1..26: mol_type = other DNA
  modified_base 5: mod_base = OTHER; note = 2 prime-4 prime methylene bridge nucleoside
  modified_base 6: mod_base = OTHER; note = 2 prime-4 prime methylene bridge-5-methylcytidine
  modified_base order(2..4,7..8,12,14..15,17..20,22..24,26): mod_base = OTHER; note = 2 prime-O-methoxyethyl nucleoside
  modified_base order(1,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1097 - DNA, 26 bp, synthetic construct
  source 1..26: mol_type = other DNA
  modified_base 7..8: mod_base = OTHER; note = 2 prime-4 prime methylene bridge nucleoside
  modified_base order(2..5,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1098 - DNA, 26 bp, synthetic construct
  source 1..26: mol_type = other DNA
  modified_base 9..10: mod_base = OTHER; note = 2 prime-4 prime methylene bridge-5-methylcytidine
  modified_base order(2..5,7..8,12,14..15,17..20,22..24,26): mod_base = OTHER; note = 2 prime-O-methoxyethyl nucleoside
  modified_base order(1,6,11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1099 - DNA, 26 bp, synthetic construct
  source 1..26: mol_type = other DNA
  modified_base 12: mod_base = OTHER; note = 2 prime-4 prime methylene bridge nucleoside
  modified_base 11: mod_base = OTHER; note = 2 prime-4 prime methylene bridge-5-methylcytidine
  modified_base order(2..5,7..8,14..15,17..20,22..24,26): mod_base = OTHER; note = 2 prime-O-methoxyethyl nucleoside
  modified_base order(1,6,9..10,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1100 - DNA, 26 bp, synthetic construct
  source 1..26: mol_type = other DNA
  modified_base 14: mod_base = OTHER; note = 2 prime-4 prime methylene bridge nucleoside
  modified_base 13: mod_base = OTHER; note = 2 prime-4 prime methylene bridge-5-methylcytidine
  modified_base order(2..5,7..8,12,15,17..20,22..24,26): mod_base = OTHER; note = 2 prime-O-methoxyethyl nucleoside
  modified_base order(1,6,9..11,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1101 - DNA, 26 bp, synthetic construct
  source 1..26: mol_type = other DNA
  modified_base 15: mod_base = OTHER; note = 2 prime-4 prime methylene bridge nucleoside
  modified_base 16: mod_base = OTHER; note = 2 prime-4 prime methylene bridge-5-methylcytidine
  modified_base order(2..5,7..8,12,14,17..20,22..24,26): mod_base = OTHER; note = 2 prime-O-methoxyethyl nucleoside
  modified_base order(1,6,9..11,13,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1102 - DNA, 26 bp, synthetic construct
  source 1..26: mol_type = other DNA
  modified_base 17..18: mod_base = OTHER; note = 2 prime-4 prime methylene bridge nucleoside
  modified_base order(2..5,7..8,12,14..15,19..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1103 - DNA, 26 bp, synthetic construct
  source 1..26: mol_type = other DNA
  modified_base 19..20: mod_base = OTHER; note = 2 prime-4 prime methylene bridge nucleoside
  modified_base order(2..5,7..8,12,14..15,17..18,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1104 - DNA, 26 bp, synthetic construct
  source 1..26: mol_type = other DNA
  modified_base 22: mod_base = OTHER; note = 2 prime-4 prime methylene bridge nucleoside
  modified_base 21: mod_base = OTHER; note = 2 prime-4 prime methylene bridge-5-methylcytidine
  modified_base order(2..5,7..8,12,14..15,17..20,23..24,26): mod_base = OTHER; note = 2 prime-O-methoxyethyl nucleoside
  modified_base order(1,6,9..11,13,16,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1105 - DNA, 26 bp, synthetic construct
  source 1..26: mol_type = other DNA
  modified_base 23..24: mod_base = OTHER; note = 2 prime-4 prime methylene bridge nucleoside
  modified_base order(2..5,7..8,12,14..15,17..20,22,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1106 - DNA, 26 bp, synthetic construct
  source 1..26: mol_type = other DNA
  modified_base 26: mod_base = OTHER; note = 2 prime-4 prime methylene bridge nucleoside
  modified_base 25: mod_base = OTHER; note = 2 prime-4 prime methylene bridge-5-methylcytidine
  modified_base order(2..5,7..8,12,14..15,17..20,22..24): mod_base = OTHER; note = 2 prime-O-methoxyethyl nucleoside
  modified_base order(1,6,9..11,13,16,21): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1107 - DNA, 26 bp, synthetic construct
  source 1..26: mol_type = other DNA
  modified_base order(3..4,23..24): mod_base = OTHER; note = 2 prime-4 prime methylene bridge nucleoside
  modified_base order(2,5,7..8,12,14..15,17..20,22,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1108 - DNA, 26 bp, synthetic construct
  source 1..26: mol_type = other DNA
  modified_base order(5,22): mod_base = OTHER; note = 2 prime-4 prime methylene bridge nucleoside
  modified_base order(6,21): mod_base = OTHER; note = 2 prime-4 prime methylene bridge-5-methylcytidine
  modified_base order(2..4,7..8,12,14..15,17..20,23..24,26): mod_base = OTHER; note = 2 prime-O-methoxyethyl nucleoside
  modified_base order(1,9..11,13,16,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1109 - DNA, 26 bp, synthetic construct
  source 1..26: mol_type = other DNA
  modified_base 17..18: mod_base = OTHER; note = 2 prime-4 prime methylene bridge nucleoside
  modified_base 9..10: mod_base = OTHER; note = 2 prime-4 prime methylene bridge-5-methylcytidine
  modified_base order(2..5,7..8,12,14..15,19..20,22..24,26): mod_base = OTHER; note = 2 prime-O-methoxyethyl nucleoside
  modified_base order(1,6,11,13,16,21,25): mod_base = OTHER; note = 2 prime-O-methoxyethyl-5-methylcytidine
  modified_base order(1..22,25^26): mod_base = OTHER; note = phosphorothioate linkage
cgaatctacccacatctgttcaatca

SEQ ID NO: 1110 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,5..11,14..26): mod_base = OTHER; note = phosphorothioate linkage
cgaatctacccacatctgttcaatca

SEQ ID NO: 1111 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,5..15,18..26): mod_base = OTHER; note = phosphorothioate linkage
cgaatctacccacatctgttcaatca

SEQ ID NO: 1112 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,4..11,13..26): mod_base = OTHER; note = phosphorothioate linkage
cgaatctacccacatctgttcaatca

SEQ ID NO: 1113 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1^2,4..15,17..26): mod_base = OTHER; note = phosphorothioate linkage
cgaatctacccacatctgttcaatca

SEQ ID NO: 1114 - DNA, 29 bp, synthetic construct
  source 1..29: mol_type = other DNA
  modified_base order(5..8,10..11,15,17..18,20..23,25..27,29): mod_base = OTHER; note = 2 prime-O-methoxyethyl nucleoside
  modified_base order(4,9,12..14,16,19,24,28): mod_base = OTHER; note = 2 prime-O-methoxyethyl-5-methylcytidine
  modified_base order(4..25,28^29): mod_base = OTHER; note = phosphorothioate linkage
  misc_feature <1: note = linked to [(1-oxohexadecyl)amino]hexyl]phosphoryl
tcacgaatctacccacatctgttcaatca

SEQ ID NO: 1115 - DNA, 26 bp, synthetic construct
  source 1..26: mol_type = other DNA
  modified_base order(2..5,7..8,12,14..15,17..20,22..24,26): mod_base = OTHER; note = 2 prime-O-N-methylacetamide nucleoside
  modified_base order(1,6,9..11,13,16,21,25): mod_base = OTHER; note = 2 prime-O-N-methylacetamide-5-methylcytidine
  modified_base 1..26: mod_base = OTHER; note = phosphorothioate linkage
cgaatctacccacatctgttcaatca

SEQ ID NO: 1116 - DNA, 26 bp, synthetic construct
  source 1..26: mol_type = other DNA
  modified_base order(1,3..6,8..9,13,15..16,18..21,23..25): mod_base = OTHER; note = 2 prime-O-N-methylacetamide nucleoside
  modified_base order(2,7,10..12,14,17,22,26): mod_base = OTHER; note = 2 prime-O-N-methylacetamide-5-methylcytidine
  modified_base 1..26: mod_base = OTHER; note = phosphorothioate linkage
acgaatctacccacatctgttcaatc

SEQ ID NO: 1117 - DNA, 26 bp, synthetic construct
  source 1..26: mol_type = other DNA
  modified_base order(2..5,7..8,12,14..15,17..20,22..24,26): mod_base = OTHER; note = 2 prime-O-methoxyethyl nucleoside
  modified_base order(1,6,9..11,13,16,21,25): mod_base = OTHER; note = 2 prime-O-methoxyethyl-5-methylcytidine
  modified_base order(1..20,21..26): mod_base = OTHER; note = phosphorothioate linkage
cgaatctacccacatctgttcaatca

SEQ ID NO: 1118 - DNA, 26 bp, synthetic construct
  source 1..26: mol_type = other DNA
  modified_base order(1,3..6,8..9,13,15..16,18..21,23..25): mod_base = OTHER; note = 2 prime-O-methoxyethyl nucleoside
  modified_base order(2,7,10..12,14,17,22,26): mod_base = OTHER; note = 2 prime-O-methoxyethyl-5-methylcytidine
  modified_base order(1..21,22..26): mod_base = OTHER; note = phosphorothioate linkage
acgaatctacccacatctgttcaatc

SEQ ID NO: 1119 - DNA, 20 bp, synthetic construct
  source 1..20: mol_type = other DNA
  modified_base 19..20: mod_base = OTHER; note = 2 prime-4 prime methylene bridge nucleoside
  modified_base 1..2: mod_base = OTHER; note = 2 prime-4 prime methylene bridge-5-methylcytidine
  modified_base order(3..4,7..8,10..11,13..16,18): mod_base = OTHER; note = 2 prime-O-methoxyethyl nucleoside
  modified_base order(5..6,9,12,17): mod_base = OTHER; note = 2 prime-O-methoxyethyl-5-methylcytidine
  modified_base 1..20: mod_base = OTHER; note = phosphorothioate linkage
ccatccatcatctgttcaat

SEQ ID NO: 1120 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..4,7..11,13..16,18..19): mod_base = OTHER; note = 2 prime-O-methoxyethyl nucleoside
  modified_base order(2,5..6,12,17): mod_base = OTHER; note = 2 prime-O-methoxyethyl-5-methylcytidine
  modified_base 1..20: mod_base = OTHER; note = phosphorothioate linkage
ccatccatgtactgttcaat

SEQ ID NO: 1121 - DNA, 20 bp, synthetic construct
  source 1..20: mol_type = other DNA
  modified_base order(1,20): mod_base = OTHER; note = 2 prime-4 prime methylene bridge-5-methylcytidine
  modified_base order(3..4,7..11,13..15,17..19): mod_base = OTHER; note = 2 prime-O-methoxyethyl nucleoside
  modified_base order(2,5..6,12,16): mod_base = OTHER; note = 2 prime-O-methoxyethyl-5-methylcytidine
  modified_base 1..20: mod_base = OTHER; note = phosphorothioate linkage
ccatccatgtactttcaatc

SEQ ID NO: 1122 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..4,7..11,13..14,16..18): mod_base = OTHER; note = 2 prime-O-methoxyethyl nucleoside
  modified_base order(2,5..6,12,15,19): mod_base = OTHER; note = 2 prime-O-methoxyethyl-5-methylcytidine
  modified_base 1..20: mod_base = OTHER; note = phosphorothioate linkage
ccatccatgtacttcaatca

SEQ ID NO: 1123 - DNA, 26 bp, synthetic construct
  source 1..26: mol_type = other DNA
  modified_base order(1,3..6,8..9,13..15,18..23,25..26): mod_base = OTHER; note = 2 prime-O-methoxyethyl nucleoside
  modified_base order(2,7,10..12,16..17,24): mod_base = OTHER; note = 2 prime-O-methoxyethyl-5-methylcytidine
  modified_base 1..26: mod_base = OTHER; note = phosphorothioate linkage
acgaatctacccaatccttttatcta

SEQ ID NO: 1124 - DNA, 26 bp, synthetic construct
  source 1..26: mol_type = other DNA
  modified_base order(2..5,7..8,12,14..15,18..23,25..26): mod_base = OTHER; note = 2 prime-O-methoxyethyl nucleoside
  modified_base order(1,6,9..11,13,16..17,24): mod_base = OTHER; note = 2 prime-O-methoxyethyl-5-methylcytidine
  modified_base 1..26: mod_base = OTHER; note = phosphorothioate linkage
cgaatctacccacatccttttatcta

SEQ ID NO: 1125 - DNA, 26 bp, synthetic construct
  source 1..26: mol_type = other DNA
  modified_base order(2,4..7,9..10,15..20,22..23,25): mod_base = OTHER; note = 2 prime-O-methoxyethyl nucleoside
  modified_base order(1,3,8,11..14,21,24,26): mod_base = OTHER; note = 2 prime-O-methoxyethyl-5-methylcytidine
  modified_base 1..26: mod_base = OTHER; note = phosphorothioate linkage
cacgaatctaccccttttatctactc

SEQ ID NO: 1126 - DNA, 26 bp, synthetic construct
  source 1..26: mol_type = other DNA
  modified_base order(1,3..6,8..9,13..14,17..22,24..25): mod_base = OTHER; note = 2 prime-O-methoxyethyl nucleoside
  modified_base order(2,7,10..12,15..16,23,26): mod_base = OTHER; note = 2 prime-O-methoxyethyl-5-methylcytidine
  modified_base 1..26: mod_base = OTHER; note = phosphorothioate linkage
acgaatctacccatccttttatctac

SEQ ID NO: 1127 - DNA, 26 bp, synthetic construct
  source 1..26: mol_type = other DNA
  modified_base order(1,3..6,8..9,13,15..20,22..23,25): mod_base = OTHER; note = 2 prime-O-methoxyethyl nucleoside
  modified_base order(2,7,10..12,14,21,24,26): mod_base = OTHER; note = 2 prime-O-methoxyethyl-5-methylcytidine
  modified_base 1..26: mod_base = OTHER; note = phosphorothioate linkage
acgaatctacccacttttatctactc

SEQ ID NO: 1128 - DNA, 26 bp, synthetic construct
  source 1..26: mol_type = other DNA
  modified_base order(2,4..7,9..10,14..15,18..23,25..26): mod_base = OTHER; note = 2 prime-O-methoxyethyl nucleoside
  modified_base order(1,3,8,11..13,16..17,24): mod_base = OTHER; note = 2 prime-O-methoxyethyl-5-methylcytidine
  modified_base 1..26: mod_base = OTHER; note = phosphorothioate linkage
cacgaatctacccatccttttatcta

SEQ ID NO: 1129 - DNA, 20 bp, synthetic construct
  source 1..20: mol_type = other DNA
  modified_base order(1,20): mod_base = OTHER; note = 2 prime-4 prime methylene bridge-5-methylcytidine
  modified_base order(3..4,7..11,13..19): mod_base = OTHER; note = 2 prime-O-methoxyethyl nucleoside
  modified_base order(2,5..6,12): mod_base = OTHER; note = 2 prime-O-methoxyethyl-5-methylcytidine
  modified_base 1..20: mod_base = OTHER; note = phosphorothioate linkage
ccatccatgtactttttatc

SEQ ID NO: 1130 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..4,7..11,13,15..19): mod_base = OTHER; note = 2 prime-O-methoxyethyl nucleoside
  modified_base order(2,5..6,12,14): mod_base = OTHER; note = 2 prime-O-methoxyethyl-5-methylcytidine
  modified_base 1..20: mod_base = OTHER; note = phosphorothioate linkage
ccatccatgtactcttttat

SEQ ID NO: 1131 - DNA, 20 bp, synthetic construct
  source 1..20: mol_type = other DNA
  modified_base order(1,20): mod_base = OTHER; note = 2 prime-4 prime methylene bridge-5-methylcytidine
  modified_base order(3..4,7..11,13..17,19): mod_base = OTHER; note = 2 prime-O-methoxyethyl nucleoside
  modified_base order(2,5..6,12,18): mod_base = OTHER; note = 2 prime-O-methoxyethyl-5-methylcytidine
  modified_base 1..20: mod_base = OTHER; note = phosphorothioate linkage
ccatccatgtacttgtactc

SEQ ID NO: 1132 - DNA, 26 bp, synthetic construct
  source 1..26: mol_type = other DNA
  modified_base order(2..5,7..8,12,15..16,19..23,25): mod_base = OTHER; note = 2 prime-O-methoxyethyl nucleoside
  modified_base order(1,6,9..11,13..14,17..18,24,26): mod_base = OTHER; note = 2 prime-O-methoxyethyl-5-methylcytidine
  modified_base 1..26: mod_base = OTHER; note = phosphorothioate linkage
cgaatctacccaccatccatgtactc

SEQ ID NO: 1133 - DNA, 26 bp, synthetic construct
  source 1..26: mol_type = other DNA
  modified_base order(2..5,7..8,12,14..15,18..22,24,26): mod_base = OTHER; note = 2 prime-O-methoxyethyl nucleoside
  modified_base order(1,6,9..11,13,16..17,23,25): mod_base = OTHER; note = 2 prime-O-methoxyethyl-5-methylcytidine
  modified_base 1..26: mod_base = OTHER; note = phosphorothioate linkage
cgaatctacccacatccatgtactca

SEQ ID NO: 1134 - DNA, 26 bp, synthetic construct
  source 1..26: mol_type = other DNA
  modified_base order(1,4,6..9,11..12,14,17..21,23,25): mod_base = OTHER; note = 2 prime-O-methoxyethyl nucleoside
  modified_base order(2..3,5,10,13,15..16,22,24,26): mod_base = OTHER; note = 2 prime-O-methoxyethyl-5-methylcytidine
  modified_base 1..26: mod_base = OTHER; note = phosphorothioate linkage
gccacgaatctactccatgtactcac

SEQ ID NO: 1135 - DNA, 26 bp, synthetic construct
  source 1..26: mol_type = other DNA
  modified_base order(1,3..6,8..9,13,15..16,19..23,25): mod_base = OTHER; note = 2 prime-O-methoxyethyl nucleoside
  modified_base order(2,7,10..12,14,17..18,24,26): mod_base = OTHER; note = 2 prime-O-methoxyethyl-5-methylcytidine
  modified_base 1..26: mod_base = OTHER; note = phosphorothioate linkage
acgaatctacccacatccatgtactc

SEQ ID NO: 1136 - DNA, 26 bp, synthetic construct
  source 1..26: mol_type = other DNA
  modified_base order(1,3..6,8..9,13..15,18..22,24,26): mod_base = OTHER; note = 2 prime-O-methoxyethyl nucleoside
  modified_base order(2,7,10..12,16..17,23,25): mod_base = OTHER; note = 2 prime-O-methoxyethyl-5-methylcytidine
  modified_base 1..26: mod_base = OTHER; note = phosphorothioate linkage
acgaatctacccaatccatgtactca

SEQ ID NO: 1137 - DNA, 26 bp, synthetic construct
  source 1..26: mol_type = other DNA
  modified_base order(2..5,7..8,12,14,17..21,23,25): mod_base = OTHER; note = 2 prime-O-methoxyethyl nucleoside
  modified_base order(1,6,9..11,13,15..16,22,24,26): mod_base = OTHER; note = 2 prime-O-methoxyethyl-5-methylcytidine
  modified_base 1..26: mod_base = OTHER; note = phosphorothioate linkage
cgaatctacccactccatgtactcac

SEQ ID NO: 1138 - DNA, 26 bp, synthetic construct
  source 1..26: mol_type = other DNA
  modified_base order(2,4..7,9..10,15..16,19..23,25): mod_base = OTHER; note = 2 prime-O-methoxyethyl nucleoside
  modified_base order(1,3,8,11..14,17..18,24,26): mod_base = OTHER; note = 2 prime-O-methoxyethyl-5-methylcytidine
  modified_base order(1..20,25^26): mod_base = OTHER; note = phosphorothioate linkage
cacgaatctaccccatccatgtactc

SEQ ID NO: 1139 - DNA, 24 bp, synthetic construct
  source 1..24: mol_type = other DNA
  modified_base order(1,3..6,8..9,13..14,17..21,23): mod_base = OTHER; note = 2 prime-O-methoxyethyl nucleoside
  modified_base order(2,7,10..12,15..16,22,24): mod_base = OTHER; note = 2 prime-O-methoxyethyl-5-methylcytidine
  modified_base 1..24: mod_base = OTHER; note = phosphorothioate linkage
acgaatctacccatccatgtactc

SEQ ID NO: 1140 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,9..10,13..17): mod_base = OTHER; note = 2 prime-O-methoxyethyl nucleoside
  modified_base order(7..8,11..12,18): mod_base = OTHER; note = 2 prime-O-methoxyethyl-5-methylcytidine
  modified_base 1..20: mod_base = OTHER; note = phosphorothioate linkage
acgaatccatccatgtactc

SEQ ID NO: 1141 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3..6,8..9,12..16,18): mod_base = OTHER; note = 2 prime-O-methoxyethyl nucleoside
  modified_base order(7,10..11,17): mod_base = OTHER; note = 2 prime-O-methoxyethyl-5-methylcytidine
  modified_base 1..20: mod_base = OTHER; note = phosphorothioate linkage
acgaatcatccatgtactca

SEQ ID NO: 1142 - DNA, 20 bp, synthetic construct
  source 1..20: mol_type = other DNA
  modified_base order(2,19): mod_base = OTHER; note = 2 prime-4 prime methylene bridge nucleoside
  modified_base order(1,20): mod_base = OTHER; note = 2 prime-4 prime methylene bridge-5-methylcytidine
  modified_base order(3..5,7,9..10,13..17): mod_base = OTHER; note = 2 prime-O-methoxyethyl nucleoside
  modified_base order(6,8,11..12,18): mod_base = OTHER; note = 2 prime-O-methoxyethyl-5-methylcytidine
  modified_base 1..20: mod_base = OTHER; note = phosphorothioate linkage
cgaatctcatccatgtactc

SEQ ID NO: 1143 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..5,7..9,12..16,18): mod_base = OTHER; note = 2 prime-O-methoxyethyl nucleoside
  modified_base order(6,10..11,17): mod_base = OTHER; note = 2 prime-O-methoxyethyl-5-methylcytidine
  modified_base 1..20: mod_base = OTHER; note = phosphorothioate linkage
cgaatctatccatgtactca

SEQ ID NO: 1144 - DNA, 20 bp, synthetic construct
  source 1..20: mol_type = other DNA
  modified_base order(1..2,19): mod_base = OTHER; note = 2 prime-4 prime methylene bridge nucleoside
  modified_base 20: mod_base = OTHER; note = 2 prime-4 prime methylene bridge-5-methylcytidine
  modified_base order(3..4,6..7,9..10,13..17): mod_base = OTHER; note = 2 prime-O-methoxyethyl nucleoside
  modified_base order(5,8,11..12,18): mod_base = OTHER; note = 2 prime-O-methoxyethyl-5-methylcytidine
  modified_base 1..20: mod_base = OTHER; note = phosphorothioate linkage
gaatctacatccatgtactc

SEQ ID NO: 1145 - DNA, 20 bp, synthetic construct
  source 1..20: mol_type = other DNA
  modified_base order(1..2,19): mod_base = OTHER; note = 2 prime-4 prime methylene bridge nucleoside
  modified_base 20: mod_base = OTHER; note = 2 prime-4 prime methylene bridge-5-methylcytidine
  modified_base order(3,5..6,9..10,13..17): mod_base = OTHER; note = 2 prime-O-methoxyethyl nucleoside
  modified_base order(4,7..8,11..12,18): mod_base = OTHER; note = 2 prime-O-methoxyethyl-5-methylcytidine
  modified_base 1..20: mod_base = OTHER; note = phosphorothioate linkage
aatctaccatccatgtactc

SEQ ID NO: 1146 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,9..10,13..17): mod_base = OTHER; note = 2 prime-O-methoxyethyl nucleoside
  modified_base order(7..8,11..12,18): mod_base = OTHER; note = 2 prime-O-methoxyethyl-5-methylcytidine
  modified_base order(1^2,4..20): mod_base = OTHER; note = phosphorothioate linkage
acgaatccatccatgtactc

SEQ ID NO: 1147 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,9..10,13..17): mod_base = OTHER; note = 2 prime-O-methoxyethyl nucleoside
  modified_base order(7..8,11..12,18): mod_base = OTHER; note = 2 prime-O-methoxyethyl-5-methylcytidine
  modified_base order(1..17,19^20): mod_base = OTHER; note = phosphorothioate linkage
acgaatccatccatgtactc

SEQ ID NO: 1148 - DNA, 20 bp, synthetic construct
  source 1..20: mol_type = other DNA
  modified_base order(1..2,19..20): mod_base = OTHER; note = 2 prime-4 prime methylene bridge nucleoside
  modified_base order(3..4,6..7,11..12,14,16): mod_base = OTHER; note = 2 prime-O-methoxyethyl nucleoside
  modified_base order(5,8..10,13,15,17..18): mod_base = OTHER; note = 2 prime-O-methoxyethyl-5-methylcytidine
  modified_base 1..20: mod_base = OTHER; note = phosphorothioate linkage
gaatctacccatctctccat

SEQ ID NO: 1149 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(4..5,7..8,11..15,17): mod_base = OTHER; note = 2 prime-O-methoxyethyl nucleoside
  modified_base order(3,6,9..10,16,18): mod_base = OTHER; note = 2 prime-O-methoxyethyl-5-methylcytidine
  modified_base 1..20: mod_base = OTHER; note = phosphorothioate linkage
tccatcatccatgtactcac

SEQ ID NO: 1150 - DNA, 20 bp, synthetic construct
  source 1..20: mol_type = other DNA
  modified_base order(1..2,19): mod_base = OTHER; note = 2 prime-4 prime methylene bridge nucleoside
  modified_base 20: mod_base = OTHER; note = 2 prime-4 prime methylene bridge-5-methylcytidine
  modified_base order(3..4,6..7,11..12,15..18): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1..20: mod_base = OTHER; note = phosphorothioate linkage
gaatctacccatccatgtac

SEQ ID NO: 1151 - DNA, 20 bp, synthetic construct
  source 1..20: mol_type = other DNA
  modified_base order(2..5,7..8,11..12,15..19): mod_base = OTHER; note = 2 prime-O-methoxyethyl nucleoside
  modified_base order(1,6,9..10,13..14,20): mod_base = OTHER; note = 2 prime-O-methoxyethyl-5-methylcytidine
  modified_base order(1^2,4..20): mod_base = OTHER; note = phosphorothioate linkage
cgaatctaccatccatgtac

SEQ ID NO: 1152 - DNA, 20 bp, synthetic construct
  source 1..20: mol_type = other DNA
  modified_base order(2..5,7..8,11..12,15..19): mod_base = OTHER; note = 2 prime-O-methoxyethyl nucleoside
  modified_base order(1,6,9..10,13..14,20): mod_base = OTHER; note = 2 prime-O-methoxyethyl-5-methylcytidine
  modified_base order(1..8,10..20): mod_base = OTHER; note = phosphorothioate linkage
cgaatctaccatccatgtac

SEQ ID NO: 1153 - DNA, 20 bp, synthetic construct
  source 1..20: mol_type = other DNA
  modified_base order(2..5,7..8,11..12,15..19): mod_base = OTHER; note = 2 prime-O-methoxyethyl nucleoside
  modified_base order(1,6,9..10,13..14,20): mod_base = OTHER; note = 2 prime-O-methoxyethyl-5-methylcytidine
  modified_base order(1..12,14..20): mod_base = OTHER; note = phosphorothioate linkage
cgaatctaccatccatgtac

SEQ ID NO: 1154 - DNA, 20 bp, synthetic construct
  source 1..20: mol_type = other DNA
  modified_base order(2..5,7..8,11..12,15..19): mod_base = OTHER; note = 2 prime-O-methoxyethyl nucleoside
  modified_base order(1,6,9..10,13..14,20): mod_base = OTHER; note = 2 prime-O-methoxyethyl-5-methylcytidine
  modified_base order(1..17,19^20): mod_base = OTHER; note = phosphorothioate linkage
cgaatctaccatccatgtac

SEQ ID NO: 1155 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(3..4,7..11,13..14,16): mod_base = OTHER; note = 2 prime-O-methoxyethyl nucleoside
  modified_base order(2,5..6,12,15,17..19): mod_base = OTHER; note = 2 prime-O-methoxyethyl-5-methylcytidine
  modified_base 1..20: mod_base = OTHER; note = phosphorothioate linkage
ccatccatgtacttcaccca

SEQ ID NO: 1156 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..20: mod_base = OTHER; note = phosphorothioate linkage
caatcatccatccatgtact

SEQ ID NO: 1157 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,4..20): mod_base = OTHER; note = phosphorothioate linkage
caatcatccatccatgtact

SEQ ID NO: 1158 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1..17,19^20): mod_base = OTHER; note = phosphorothioate linkage
caatcatccatccatgtact

SEQ ID NO: 1159 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3,5..7,10..11,14..18): mod_base = OTHER; note = 2 prime-O-methoxyethyl nucleoside
  modified_base order(4,8..9,12..13): mod_base = OTHER; note = 2 prime-O-methoxyethyl-5-methylcytidine
  modified_base 1..20: mod_base = OTHER; note = phosphorothioate linkage
gttcaatccatccatgtact

SEQ ID NO: 1160 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(4..6,10..11,14..18): mod_base = OTHER; note = 2 prime-O-methoxyethyl nucleoside
  modified_base order(3,7..9,12..13): mod_base = OTHER; note = 2 prime-O-methoxyethyl-5-methylcytidine
  modified_base 1..20: mod_base = OTHER; note = phosphorothioate linkage
ttcaatcccatccatgtact

SEQ ID NO: 1161 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3..5,7,10..11,14..18): mod_base = OTHER; note = 2 prime-O-methoxyethyl nucleoside
  modified_base order(6,8..9,12..13): mod_base = OTHER; note = 2 prime-O-methoxyethyl-5-methylcytidine
  modified_base 1..20: mod_base = OTHER; note = phosphorothioate linkage
tcaatcaccatccatgtact

SEQ ID NO: 1162 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..6,10..11,14..18): mod_base = OTHER; note = 2 prime-O-methoxyethyl nucleoside
  modified_base order(7..9,12..13): mod_base = OTHER; note = 2 prime-O-methoxyethyl-5-methylcytidine
  modified_base 1..20: mod_base = OTHER; note = phosphorothioate linkage
ttttatcccatccatgtact

SEQ ID NO: 1163 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..7,10..11,14..18): mod_base = OTHER; note = 2 prime-O-methoxyethyl nucleoside
  modified_base order(8..9,12..13): mod_base = OTHER; note = 2 prime-O-methoxyethyl-5-methylcytidine
  modified_base 1..20: mod_base = OTHER; note = phosphorothioate linkage
cttttatccatccatgtact

SEQ ID NO: 1164 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3,7,10..11,14..18): mod_base = OTHER; note = 2 prime-O-methoxyethyl nucleoside
  modified_base order(4..6,8..9,12..13): mod_base = OTHER; note = 2 prime-O-methoxyethyl-5-methylcytidine
  modified_base 1..20: mod_base = OTHER; note = phosphorothioate linkage
tcacccaccatccatgtact

SEQ ID NO: 1165 - DNA, 26 bp, synthetic construct
  source 1..26: mol_type = other DNA
  modified_base order(3..4,7..11,13,16..17,20..24,26): mod_base = OTHER; note = 2 prime-O-methoxyethyl nucleoside
  modified_base order(1..2,5..6,12,14..15,18..19,25): mod_base = OTHER; note = 2 prime-O-methoxyethyl-5-methylcytidine
  modified_base 1..26: mod_base = OTHER; note = phosphorothioate linkage
ccatccatgtactccatccatgtact

SEQ ID NO: 1166 - DNA, 13 bp, synthetic construct
  source 1..13: mol_type = other DNA
  modified_base order(3..4,7..11,13): mod_base = OTHER; note = 2 prime-O-methoxyethyl nucleoside
  modified_base order(1..2,5..6,12): mod_base = OTHER; note = 2 prime-O-methoxyethyl-5-methylcytidine
  modified_base 1..13: mod_base = OTHER; note = phosphorothioate linkage
ccatccatgtact

SEQ ID NO: 1167 - DNA, 13 bp, synthetic construct
  source 1..13: mol_type = other DNA
  modified_base order(3..4,7..11,13): mod_base = OTHER; note = 2 prime-O-methoxyethyl nucleoside
  modified_base order(1..2,5..6,12): mod_base = OTHER; note = 2 prime-O-methoxyethyl-5-methylcytidine
  modified_base 2..13: mod_base = OTHER; note = phosphorothioate linkage
ccatccatgtact

SEQ ID NO: 1168 - DNA, 13 bp, synthetic construct
  source 1..13: mol_type = other DNA
  modified_base order(3..4,7..8,10..11): mod_base = OTHER; note = 2 prime-O-methoxyethyl nucleoside
  modified_base order(1..2,5..6,9,12..13): mod_base = OTHER; note = 2 prime-O-methoxyethyl-5-methylcytidine
  modified_base 1..13: mod_base = OTHER; note = phosphorothioate linkage
ccatccatcatcc

SEQ ID NO: 1169 - DNA, 13 bp, synthetic construct
  source 1..13: mol_type = other DNA
  modified_base 1..12: mod_base = OTHER; note = 2 prime-O-methoxyethyl nucleoside
  modified_base 13: mod_base = OTHER; note = 2 prime-O-methoxyethyl-5-methylcytidine
  modified_base 2..13: mod_base = OTHER; note = phosphorothioate linkage
gggataagagttc

SEQ ID NO: 1170 - DNA, 26 bp, synthetic construct
  source 1..26: mol_type = other DNA
  modified_base order(1,4,6..9,11..12,14,17..18,21..25): mod_base = OTHER; note = 2 prime-O-methoxyethyl nucleoside
  modified_base order(2..3,5,10,13,15..16,19..20,26): mod_base = OTHER; note = 2 prime-O-methoxyethyl-5-methylcytidine
  modified_base 1..26: mod_base = OTHER; note = phosphorothioate linkage
gccacgaatctactccatccatgtac

SEQ ID NO: 1171 - DNA, 26 bp, synthetic construct
  source 1..26: mol_type = other DNA
  modified_base order(1,4,6..9,11..12,16..17,20..24,26): mod_base = OTHER; note = 2 prime-O-methoxyethyl nucleoside
  modified_base order(2..3,5,10,13..15,18..19,25): mod_base = OTHER; note = 2 prime-O-methoxyethyl-5-methylcytidine
  modified_base 1..26: mod_base = OTHER; note = phosphorothioate linkage
gccacgaatctacccatccatgtact

SEQ ID NO: 1172 - DNA, 26 bp, synthetic construct
  source 1..26: mol_type = other DNA
  modified_base order(2,4..7,9..10,14,17..18,21..25): mod_base = OTHER; note = 2 prime-O-methoxyethyl nucleoside
  modified_base order(1,3,8,11..13,15..16,19..20,26): mod_base = OTHER; note = 2 prime-O-methoxyethyl-5-methylcytidine
  modified_base 1..26: mod_base = OTHER; note = phosphorothioate linkage
cacgaatctaccctccatccatgtac

SEQ ID NO: 1173 - DNA, 26 bp, synthetic construct
  source 1..26: mol_type = other DNA
  modified_base order(1,3..6,8..9,13,16..17,20..24,26): mod_base = OTHER; note = 2 prime-O-methoxyethyl nucleoside
  modified_base order(2,7,10..12,14..15,18..19,25): mod_base = OTHER; note = 2 prime-O-methoxyethyl-5-methylcytidine
  modified_base 1..26: mod_base = OTHER; note = phosphorothioate linkage
acgaatctacccaccatccatgtact

SEQ ID NO: 1174 - DNA, 26 bp, synthetic construct
  source 1..26: mol_type = other DNA
  modified_base order(3,5..8,10..11,16..17,20..24,26): mod_base = OTHER; note = 2 prime-O-methoxyethyl nucleoside
  modified_base order(1..2,4,9,12..15,18..19,25): mod_base = OTHER; note = 2 prime-O-methoxyethyl-5-methylcytidine
  modified_base 1..26: mod_base = OTHER; note = phosphorothioate linkage
ccacgaatctaccccatccatgtact

SEQ ID NO: 1175 - DNA, 26 bp, synthetic construct
  source 1..26: mol_type = other DNA
  modified_base order(2,26): mod_base = OTHER; note = 2 prime-4 prime methylene bridge nucleoside
  modified_base order(1,25): mod_base = OTHER; note = 2 prime-4 prime methylene bridge-5-methylcytidine
  modified_base order(4..7,9..10,16..17,20..24): mod_base = OTHER; note = 2 prime-O-methoxyethyl nucleoside
  modified_base order(3,8,11..15,18..19): mod_base = OTHER; note = 2 prime-O-methoxyethyl-5-methylcytidine
  modified_base 1..26: mod_base = OTHER; note = phosphorothioate linkage
cacgaatctacccccatccatgtact

SEQ ID NO: 1176 - DNA, 26 bp, synthetic construct
  source 1..26: mol_type = other DNA
  modified_base 16: mod_base = OTHER; note = 2 prime-4 prime methylene bridge nucleoside
  modified_base 15: mod_base = OTHER; note = 2 prime-4 prime methylene bridge-5-methylcytidine
  modified_base order(2,4..7,9..10,17,20..24,26): mod_base = OTHER; note = 2 prime-O-methoxyethyl nucleoside
  modified_base order(1,3,8,11..14,18..19,25): mod_base = OTHER; note = 2 prime-O-methoxyethyl-5-methylcytidine
  modified_base order(1..15,17..26): mod_base = OTHER; note = phosphorothioate linkage
cacgaatctacccccatccatgtact

SEQ ID NO: 1177 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base order(1^2,4..24): mod_base = OTHER; note = phosphorothioate linkage
acgaatctacccccatccatgtac

SEQ ID NO: 1178 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base order(1..10,12..24): mod_base = OTHER; note = phosphorothioate linkage
acgaatctacccccatccatgtac

SEQ ID NO: 1179 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base order(1..14,16..24): mod_base = OTHER; note = phosphorothioate linkage
acgaatctacccccatccatgtac

SEQ ID NO: 1180 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base order(1..21,23^24): mod_base = OTHER; note = phosphorothioate linkage
acgaatctacccccatccatgtac

SEQ ID NO: 1181 - DNA, 24 bp, synthetic construct
  source 1..24: mol_type = other DNA
  modified_base order(1,3..6,8..9,15..16,19..23): mod_base = OTHER; note = 2 prime-O-methoxyethyl nucleoside
  modified_base order(2,7,10..14,17..18,24): mod_base = OTHER; note = 2 prime-O-methoxyethyl-5-methylcytidine
  modified_base order(1..18,23^24): mod_base = OTHER; note = phosphorothioate linkage
acgaatctacccccatccatgtac

SEQ ID NO: 1182 - DNA, 22 bp, synthetic construct
  source 1..22: mol_type = other DNA
  modified_base order(1,3..6,8..10,13..14,17..21): mod_base = OTHER; note = 2 prime-O-methoxyethyl nucleoside
  modified_base order(2,7,11..12,15..16,22): mod_base = OTHER; note = 2 prime-O-methoxyethyl-5-methylcytidine
  modified_base 1..22: mod_base = OTHER; note = phosphorothioate linkage
acgaatctatccatccatgtac

SEQ ID NO: 1183 - DNA, 26 bp, synthetic construct
  source 1..26: mol_type = other DNA
  modified_base order(2..5,7..8,12,16..17,20..24,26): mod_base = OTHER; note = 2 prime-O-methoxyethyl nucleoside
  modified_base order(1,6,9..11,13..15,18..19,25): mod_base = OTHER; note = 2 prime-O-methoxyethyl-5-methylcytidine
  modified_base 1..26: mod_base = OTHER; note = phosphorothioate linkage
cgaatctacccacccatccatgtact

SEQ ID NO: 1184 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3..6,10..11,14..18): mod_base = OTHER; note = 2 prime-O-methoxyethyl nucleoside
  modified_base order(7..9,12..13): mod_base = OTHER; note = 2 prime-O-methoxyethyl-5-methylcytidine
  modified_base 1..20: mod_base = OTHER; note = phosphorothioate linkage
acgaatcccatccatgtact

SEQ ID NO: 1185 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(4,6..7,10..11,14..18): mod_base = OTHER; note = 2 prime-O-methoxyethyl nucleoside
  modified_base order(3,5,8..9,12..13): mod_base = OTHER; note = 2 prime-O-methoxyethyl-5-methylcytidine
  modified_base 1..20: mod_base = OTHER; note = phosphorothioate linkage
gccacgaccatccatgtact

SEQ ID NO: 1186 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..5,7,10..11,14..18): mod_base = OTHER; note = 2 prime-O-methoxyethyl nucleoside
  modified_base order(6,8..9,12..13): mod_base = OTHER; note = 2 prime-O-methoxyethyl-5-methylcytidine
  modified_base 1..20: mod_base = OTHER; note = phosphorothioate linkage
cgaatctccatccatgtact

SEQ ID NO: 1187 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1188 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3,5..6,10..11,14..18): mod_base = OTHER; note = 2 prime-O-methoxyethyl nucleoside
  modified_base order(4,7..9,12..13): mod_base = OTHER; note = 2 prime-O-methoxyethyl-5-methylcytidine
  modified_base 1..20: mod_base = OTHER; note = phosphorothioate linkage
aatctacccatccatgtact

SEQ ID NO: 1189 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,8,11..12,15..18): mod_base = OTHER; note = 2 prime-O-methoxyethyl nucleoside
  modified_base order(7,9..10,13..14): mod_base = OTHER; note = 2 prime-O-methoxyethyl-5-methylcytidine
  modified_base 1..20: mod_base = OTHER; note = phosphorothioate linkage
acgaatctccatccatgtac

SEQ ID NO: 1190 - DNA, 20 bp, synthetic construct
  source 1..20: mol_type = other DNA
  modified_base order(2,19): mod_base = OTHER; note = 2 prime-4 prime methylene bridge nucleoside
  modified_base order(1,20): mod_base = OTHER; note = 2 prime-4 prime methylene bridge-5-methylcytidine
  modified_base order(3..5,7..8,11..12,15..18): mod_base = OTHER; note = 2 prime-O-methoxyethyl nucleoside
  modified_base order(6,9..10,13..14): mod_base = OTHER; note = 2 prime-O-methoxyethyl-5-methylcytidine
  modified_base 1..20: mod_base = OTHER; note = phosphorothioate linkage
cgaatcttccatccatgtac

SEQ ID NO: 1191 - DNA, 20 bp, synthetic construct
  source 1..20: mol_type = other DNA
  modified_base order(1..2,19): mod_base = OTHER; note = 2 prime-4 prime methylene bridge nucleoside
  modified_base 20: mod_base = OTHER; note = 2 prime-4 prime methylene bridge-5-methylcytidine
  modified_base order(3..4,6..8,11..12,15..18): mod_base = OTHER; note = 2 prime-O-methoxyethyl nucleoside
  modified_base order(5,9..10,13..14): mod_base = OTHER; note = 2 prime-O-methoxyethyl-5-methylcytidine
  modified_base 1..20: mod_base = OTHER; note = phosphorothioate linkage
gaatctatccatccatgtac

SEQ ID NO: 1192 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,4..20): mod_base = OTHER; note = phosphorothioate linkage
gaatctaccatccatgtact

SEQ ID NO: 1193 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1194 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1..17,19^20): mod_base = OTHER; note = phosphorothioate linkage
gaatctaccatccatgtact

SEQ ID NO: 1195 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1..16,19^20): mod_base = OTHER; note = phosphorothioate linkage
gaatctaccatccatgtact

SEQ ID NO: 1196 - DNA, 20 bp, synthetic construct
  source 1..20: mol_type = other DNA
  modified_base order(1..2,6..7,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1..6,8..20): mod_base = OTHER; note = phosphorothioate linkage
gaatctaccatccatgtact

SEQ ID NO: 1197 - DNA, 20 bp, synthetic construct
  source 1..20: mol_type = other DNA
  modified_base order(1..2,20): mod_base = OTHER; note = 2 prime-4 prime methylene bridge nucleoside
  modified_base order(8..9,19): mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,12..13): mod_base = OTHER; note = 2 prime-O-methoxyethyl-5-methylcytidine
  modified_base order(1..8,10..20): mod_base = OTHER; note = phosphorothioate linkage
gaatctaccatccatgtact

SEQ ID NO: 1198 - DNA, 20 bp, synthetic construct
  source 1..20: mol_type = other DNA
  modified_base order(1..2,7,20): mod_base = OTHER; note = 2 prime-4 prime methylene bridge nucleoside
  modified_base order(8,19): mod_base = OTHER; note = 2 prime-4 prime methylene bridge-5-methylcytidine
  modified_base order(3..4,6,10..11,14..18): mod_base = OTHER; note = 2 prime-O-methoxyethyl nucleoside
  modified_base order(5,9,12..13): mod_base = OTHER; note = 2 prime-O-methoxyethyl-5-methylcytidine
  modified_base order(1..7,9..20): mod_base = OTHER; note = phosphorothioate linkage
gaatctaccatccatgtact

SEQ ID NO: 1199 - DNA, 20 bp, synthetic construct
  source 1..20: mol_type = other DNA
  modified_base order(1..2,20): mod_base = OTHER; note = 2 prime-4 prime methylene bridge nucleoside
  modified_base order(12..13,19): mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9): mod_base = OTHER; note = 2 prime-O-methoxyethyl-5-methylcytidine
  modified_base order(1..12,14..20): mod_base = OTHER; note = phosphorothioate linkage
gaatctaccatccatgtact

SEQ ID NO: 1200 - DNA, 20 bp, synthetic construct
  source 1..20: mol_type = other DNA
  modified_base order(2,11,19): mod_base = OTHER; note = 2 prime-4 prime methylene bridge nucleoside
  modified_base order(1,10,20): mod_base = OTHER; note = 2 prime-4 prime methylene bridge-5-methylcytidine
  modified_base order(3..5,7..8,12,15..18): mod_base = OTHER; note = 2 prime-O-methoxyethyl nucleoside
  modified_base order(6,9,13..14): mod_base = OTHER; note = 2 prime-O-methoxyethyl-5-methylcytidine
  modified_base order(1^2,4..20): mod_base = OTHER; note = phosphorothioate linkage
cgaatctaccatccatgtac

SEQ ID NO: 1201 - DNA, 20 bp, synthetic construct
  source 1..20: mol_type = other DNA
  modified_base order(2,11,19): mod_base = OTHER; note = 2 prime-4 prime methylene bridge nucleoside
  modified_base order(1,10,20): mod_base = OTHER; note = 2 prime-4 prime methylene bridge-5-methylcytidine
  modified_base order(3..5,7..8,12,15..18): mod_base = OTHER; note = 2 prime-O-methoxyethyl nucleoside
  modified_base order(6,9,13..14): mod_base = OTHER; note = 2 prime-O-methoxyethyl-5-methylcytidine
  modified_base order(1^2,5..20): mod_base = OTHER; note = phosphorothioate linkage
cgaatctaccatccatgtac

SEQ ID NO: 1202 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,8,11..12,15..18): mod_base = OTHER; note = 2 prime-O-methoxyethyl nucleoside
  modified_base order(7,9..10,13..14): mod_base = OTHER; note = 2 prime-O-methoxyethyl-5-methylcytidine
  modified_base order(1^2,4..20): mod_base = OTHER; note = phosphorothioate linkage
acgaatctccatccatgtac

SEQ ID NO: 1203 - DNA, 20 bp, synthetic construct
  source 1..20: mol_type = other DNA
  modified_base order(1,19): mod_base = OTHER; note = 2 prime-4 prime methylene bridge nucleoside
  modified_base order(2,20): mod_base = OTHER; note = 2 prime-4 prime methylene bridge-5-methylcytidine
  modified_base order(3..6,8,11..12,15..18): mod_base = OTHER; note = 2 prime-O-methoxyethyl nucleoside
  modified_base order(7,9..10,13..14): mod_base = OTHER; note = 2 prime-O-methoxyethyl-5-methylcytidine
  modified_base order(1..17,19^20): mod_base = OTHER; note = phosphorothioate linkage
acgaatctccatccatgtac

SEQ ID NO: 1204 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3..6,10..11,14..18): mod_base = OTHER; note = 2 prime-O-methoxyethyl nucleoside
  modified_base order(7..9,12..13): mod_base = OTHER; note = 2 prime-O-methoxyethyl-5-methylcytidine
  modified_base order(1^2,4..20): mod_base = OTHER; note = phosphorothioate linkage
acgaatcccatccatgtact

SEQ ID NO: 1205 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..5,7,10..11,14..18): mod_base = OTHER; note = 2 prime-O-methoxyethyl nucleoside
  modified_base order(6,8..9,12..13): mod_base = OTHER; note = 2 prime-O-methoxyethyl-5-methylcytidine
  modified_base order(1^2,4..20): mod_base = OTHER; note = phosphorothioate linkage
cgaatctccatccatgtact

SEQ ID NO: 1206 - DNA, 20 bp, synthetic construct
  source 1..20: mol_type = other DNA
  modified_base order(2,20): mod_base = OTHER; note = 2 prime-4 prime methylene bridge nucleoside
  modified_base order(1,19): mod_base = OTHER; note = 2 prime-4 prime methylene bridge-5-methylcytidine
  modified_base order(3..5,7,10..11,14..18): mod_base = OTHER; note = 2 prime-O-methoxyethyl nucleoside
  modified_base order(6,8..9,12..13): mod_base = OTHER; note = 2 prime-O-methoxyethyl-5-methylcytidine
  modified_base order(1..17,19^20): mod_base = OTHER; note = phosphorothioate linkage
cgaatctccatccatgtact

SEQ ID NO: 1207 - DNA, 20 bp, synthetic construct
  source 1..20: mol_type = other DNA
  modified_base order(1..4,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1208 - DNA, 20 bp, synthetic construct
  source 1..20: mol_type = other DNA
  modified_base order(1,7,20): mod_base = OTHER; note = 2 prime-4 prime methylene bridge nucleoside
  modified_base 8: mod_base = OTHER; note = 2 prime-4 prime methylene bridge-5-methylcytidine
  modified_base order(2..4,6,10..11,14..18): mod_base = OTHER; note = 2 prime-O-methoxyethyl nucleoside
  modified_base order(5,9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1209 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,4..20): mod_base = OTHER; note = phosphorothioate linkage
gaatctaccatccatgtact

SEQ ID NO: 1210 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..17,19^20): mod_base = OTHER; note = phosphorothioate linkage
gaatctaccatccatgtact

SEQ ID NO: 1211 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,4..17,19^20): mod_base = OTHER; note = phosphorothioate linkage
gaatctaccatccatgtact

SEQ ID NO: 1212 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,4..7,9..20): mod_base = OTHER; note = phosphorothioate linkage
gaatctaccatccatgtact

SEQ ID NO: 1213 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..7,9..17,19^20): mod_base = OTHER; note = phosphorothioate linkage
gaatctaccatccatgtact

SEQ ID NO: 1214 - DNA, 19 bp, synthetic construct
  source 1..19: mol_type = other DNA
  modified_base order(1..2,18): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..17): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..19: mod_base = OTHER; note = phosphorothioate linkage
gaatctaccatccatgtac

SEQ ID NO: 1215 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1216 - DNA, 20 bp, synthetic construct
  source 1..20: mol_type = other DNA
  modified_base order(1,20): mod_base = OTHER; note = 2 prime-4 prime methylene bridge nucleoside
  modified_base 8..9: mod_base = OTHER; note = 2 prime-4 prime methylene bridge-5-methylcytidine
  modified_base order(2..4,6..7,10..11,14..18): mod_base = OTHER; note = 2 prime-O-methoxyethyl nucleoside
  modified_base order(5,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1217 - DNA, 20 bp, synthetic construct
  source 1..20: mol_type = other DNA
  modified_base order(1,7,10,20): mod_base = OTHER; note = 2 prime-4 prime methylene bridge nucleoside
  modified_base order(2..4,6,11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1218 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1219 - DNA, 21 bp, synthetic construct
  source 1..21: mol_type = other DNA
  modified_base 21: mod_base = OTHER; note = 2 prime-4 prime methylene bridge nucleoside
  modified_base 1: mod_base = OTHER; note = 2 prime-4 prime methylene bridge-5-methylcytidine
  modified_base order(2..5,7..8,11..12,15..19): mod_base = OTHER; note = 2 prime-O-methoxyethyl nucleoside
  modified_base order(6,9..10,13..14,20): mod_base = OTHER; note = 2 prime-O-methoxyethyl-5-methylcytidine
  modified_base 1..21: mod_base = OTHER; note = phosphorothioate linkage
cgaatctaccatccatgtact

SEQ ID NO: 1220 - DNA, 22 bp, synthetic construct
  source 1..22: mol_type = other DNA
  modified_base order(1,22): mod_base = OTHER; note = 2 prime-4 prime methylene bridge nucleoside
  modified_base order(3..6,8..9,12..13,16..20): mod_base = OTHER; note = 2 prime-O-methoxyethyl nucleoside
  modified_base order(2,7,10..11,14..15,21): mod_base = OTHER; note = 2 prime-O-methoxyethyl-5-methylcytidine
  modified_base 1..22: mod_base = OTHER; note = phosphorothioate linkage
acgaatctaccatccatgtact

SEQ ID NO: 1221 - DNA, 23 bp, synthetic construct
  source 1..23: mol_type = other DNA
  modified_base 23: mod_base = OTHER; note = 2 prime-4 prime methylene bridge nucleoside
  modified_base 1: mod_base = OTHER; note = 2 prime-4 prime methylene bridge-5-methylcytidine
  modified_base order(2,4..7,9..10,13..14,17..21): mod_base = OTHER; note = 2 prime-O-methoxyethyl nucleoside
  modified_base order(3,8,11..12,15..16,22): mod_base = OTHER; note = 2 prime-O-methoxyethyl-5-methylcytidine
  modified_base 1..23: mod_base = OTHER; note = phosphorothioate linkage
cacgaatctaccatccatgtact

SEQ ID NO: 1222 - DNA, 24 bp, synthetic construct
  source 1..24: mol_type = other DNA
  modified_base 24: mod_base = OTHER; note = 2 prime-4 prime methylene bridge nucleoside
  modified_base 1: mod_base = OTHER; note = 2 prime-4 prime methylene bridge-5-methylcytidine
  modified_base order(3,5..8,10..11,14..15,18..22): mod_base = OTHER; note = 2 prime-O-methoxyethyl nucleoside
  modified_base order(2,4,9,12..13,16..17,23): mod_base = OTHER; note = 2 prime-O-methoxyethyl-5-methylcytidine
  modified_base 1..24: mod_base = OTHER; note = phosphorothioate linkage
ccacgaatctaccatccatgtact

SEQ ID NO: 1223 - DNA, 24 bp, synthetic construct
  source 1..24: mol_type = other DNA
  modified_base order(3,5..8,10..11,14..15,18..22,24): mod_base = OTHER; note = 2 prime-O-methoxyethyl nucleoside
  modified_base order(1..2,4,9,12..13,16..17,23): mod_base = OTHER; note = 2 prime-O-methoxyethyl-5-methylcytidine
  modified_base 1..24: mod_base = OTHER; note = phosphorothioate linkage
ccacgaatctaccatccatgtact

SEQ ID NO: 1224 - DNA, 20 bp, synthetic construct
  source 1..20: mol_type = other DNA
  modified_base 1..2: mod_base = OTHER; note = 2 prime-4 prime methylene bridge nucleoside
  modified_base order(3..4,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1225 - DNA, 20 bp, synthetic construct
  source 1..20: mol_type = other DNA
  modified_base 3..4: mod_base = OTHER; note = 2 prime-4 prime methylene bridge nucleoside
  modified_base order(1..2,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1226 - DNA, 20 bp, synthetic construct
  source 1..20: mol_type = other DNA
  modified_base 6: mod_base = OTHER; note = 2 prime-4 prime methylene bridge nucleoside
  modified_base 5: mod_base = OTHER; note = 2 prime-4 prime methylene bridge-5-methylcytidine
  modified_base order(1..4,7,10..11,14..18,20): mod_base = OTHER; note = 2 prime-O-methoxyethyl nucleoside
  modified_base order(8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1227 - DNA, 20 bp, synthetic construct
  source 1..20: mol_type = other DNA
  modified_base 7: mod_base = OTHER; note = 2 prime-4 prime methylene bridge nucleoside
  modified_base 8: mod_base = OTHER; note = 2 prime-4 prime methylene bridge-5-methylcytidine
  modified_base order(1..4,6,10..11,14..18,20): mod_base = OTHER; note = 2 prime-O-methoxyethyl nucleoside
  modified_base order(5,9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1228 - DNA, 20 bp, synthetic construct
  source 1..20: mol_type = other DNA
  modified_base 10: mod_base = OTHER; note = 2 prime-4 prime methylene bridge nucleoside
  modified_base 9: mod_base = OTHER; note = 2 prime-4 prime methylene bridge-5-methylcytidine
  modified_base order(1..4,6..7,11,14..18,20): mod_base = OTHER; note = 2 prime-O-methoxyethyl nucleoside
  modified_base order(5,8,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1229 - DNA, 20 bp, synthetic construct
  source 1..20: mol_type = other DNA
  modified_base 11: mod_base = OTHER; note = 2 prime-4 prime methylene bridge nucleoside
  modified_base 12: mod_base = OTHER; note = 2 prime-4 prime methylene bridge-5-methylcytidine
  modified_base order(1..4,6..7,10,14..18,20): mod_base = OTHER; note = 2 prime-O-methoxyethyl nucleoside
  modified_base order(5,8..9,13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1230 - DNA, 20 bp, synthetic construct
  source 1..20: mol_type = other DNA
  modified_base 14: mod_base = OTHER; note = 2 prime-4 prime methylene bridge nucleoside
  modified_base 13: mod_base = OTHER; note = 2 prime-4 prime methylene bridge-5-methylcytidine
  modified_base order(1..4,6..7,10..11,15..18,20): mod_base = OTHER; note = 2 prime-O-methoxyethyl nucleoside
  modified_base order(5,8..9,12,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1231 - DNA, 20 bp, synthetic construct
  source 1..20: mol_type = other DNA
  modified_base 15..16: mod_base = OTHER; note = 2 prime-4 prime methylene bridge nucleoside
  modified_base order(1..4,6..7,10..11,14,17..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1232 - DNA, 20 bp, synthetic construct
  source 1..20: mol_type = other DNA
  modified_base 17..18: mod_base = OTHER; note = 2 prime-4 prime methylene bridge nucleoside
  modified_base order(1..4,6..7,10..11,14..16,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1233 - DNA, 20 bp, synthetic construct
  source 1..20: mol_type = other DNA
  modified_base 20: mod_base = OTHER; note = 2 prime-4 prime methylene bridge nucleoside
  modified_base 19: mod_base = OTHER; note = 2 prime-4 prime methylene bridge-5-methylcytidine
  modified_base order(1..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1234 - DNA, 20 bp, synthetic construct
  source 1..20: mol_type = other DNA
  modified_base order(3,7,14,18): mod_base = OTHER; note = 2 prime-4 prime methylene bridge nucleoside
  modified_base order(1..2,4,6,10..11,15..17,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1235 - DNA, 20 bp, synthetic construct
  source 1..20: mol_type = other DNA
  modified_base order(1,6,14,20): mod_base = OTHER; note = 2 prime-4 prime methylene bridge nucleoside
  modified_base order(2..4,7,10..11,15..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1236 - DNA, 20 bp, synthetic construct
  source 1..20: mol_type = other DNA
  modified_base order(3..4,17..18): mod_base = OTHER; note = 2 prime-4 prime methylene bridge nucleoside
  modified_base order(1..2,6..7,10..11,14..16,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1237 - DNA, 20 bp, synthetic construct
  source 1..20: mol_type = other DNA
  modified_base order(7,14): mod_base = OTHER; note = 2 prime-4 prime methylene bridge nucleoside
  modified_base order(8,13): mod_base = OTHER; note = 2 prime-4 prime methylene bridge-5-methylcytidine
  modified_base order(1..4,6,10..11,15..18,20): mod_base = OTHER; note = 2 prime-O-methoxyethyl nucleoside
  modified_base order(5,9,12,19): mod_base = OTHER; note = 2 prime-O-methoxyethyl-5-methylcytidine
  modified_base order(1^2,5..20): mod_base = OTHER; note = phosphorothioate linkage
gaatctaccatccatgtact

SEQ ID NO: 1238 - DNA, 20 bp, synthetic construct
  source 1..20: mol_type = other DNA
  modified_base 1..2: mod_base = OTHER; note = 2 prime-4 prime methylene bridge nucleoside
  modified_base order(3..4,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1239 - DNA, 20 bp, synthetic construct
  source 1..20: mol_type = other DNA
  modified_base 3..4: mod_base = OTHER; note = 2 prime-4 prime methylene bridge nucleoside
  modified_base order(1..2,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1240 - DNA, 20 bp, synthetic construct
  source 1..20: mol_type = other DNA
  modified_base 6: mod_base = OTHER; note = 2 prime-4 prime methylene bridge nucleoside
  modified_base 5: mod_base = OTHER; note = 2 prime-4 prime methylene bridge-5-methylcytidine
  modified_base order(1..4,7,10..11,14..18,20): mod_base = OTHER; note = 2 prime-O-methoxyethyl nucleoside
  modified_base order(8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1241 - DNA, 20 bp, synthetic construct
  source 1..20: mol_type = other DNA
  modified_base 7: mod_base = OTHER; note = 2 prime-4 prime methylene bridge nucleoside
  modified_base 8: mod_base = OTHER; note = 2 prime-4 prime methylene bridge-5-methylcytidine
  modified_base order(1..4,6,10..11,14..18,20): mod_base = OTHER; note = 2 prime-O-methoxyethyl nucleoside
  modified_base order(5,9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1242 - DNA, 20 bp, synthetic construct
  source 1..20: mol_type = other DNA
  modified_base 10: mod_base = OTHER; note = 2 prime-4 prime methylene bridge nucleoside
  modified_base 9: mod_base = OTHER; note = 2 prime-4 prime methylene bridge-5-methylcytidine
  modified_base order(1..4,6..7,11,14..18,20): mod_base = OTHER; note = 2 prime-O-methoxyethyl nucleoside
  modified_base order(5,8,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1243 - DNA, 20 bp, synthetic construct
  source 1..20: mol_type = other DNA
  modified_base 11: mod_base = OTHER; note = 2 prime-4 prime methylene bridge nucleoside
  modified_base 12: mod_base = OTHER; note = 2 prime-4 prime methylene bridge-5-methylcytidine
  modified_base order(1..4,6..7,10,14..18,20): mod_base = OTHER; note = 2 prime-O-methoxyethyl nucleoside
  modified_base order(5,8..9,13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1244 - DNA, 20 bp, synthetic construct
  source 1..20: mol_type = other DNA
  modified_base 14: mod_base = OTHER; note = 2 prime-4 prime methylene bridge nucleoside
  modified_base 13: mod_base = OTHER; note = 2 prime-4 prime methylene bridge-5-methylcytidine
  modified_base order(1..4,6..7,10..11,15..18,20): mod_base = OTHER; note = 2 prime-O-methoxyethyl nucleoside
  modified_base order(5,8..9,12,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1245 - DNA, 20 bp, synthetic construct
  source 1..20: mol_type = other DNA
  modified_base 15..16: mod_base = OTHER; note = 2 prime-4 prime methylene bridge nucleoside
  modified_base order(1..4,6..7,10..11,14,17..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1246 - DNA, 20 bp, synthetic construct
  source 1..20: mol_type = other DNA
  modified_base 17..18: mod_base = OTHER; note = 2 prime-4 prime methylene bridge nucleoside
  modified_base order(1..4,6..7,10..11,14..16,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1247 - DNA, 20 bp, synthetic construct
  source 1..20: mol_type = other DNA
  modified_base 20: mod_base = OTHER; note = 2 prime-4 prime methylene bridge nucleoside
  modified_base 19: mod_base = OTHER; note = 2 prime-4 prime methylene bridge-5-methylcytidine
  modified_base order(1..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1248 - DNA, 20 bp, synthetic construct
  source 1..20: mol_type = other DNA
  modified_base order(3,7,14,18): mod_base = OTHER; note = 2 prime-4 prime methylene bridge nucleoside
  modified_base order(1..2,4,6,10..11,15..17,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1249 - DNA, 20 bp, synthetic construct
  source 1..20: mol_type = other DNA
  modified_base order(1,6,14,20): mod_base = OTHER; note = 2 prime-4 prime methylene bridge nucleoside
  modified_base order(2..4,7,10..11,15..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1250 - DNA, 20 bp, synthetic construct
  source 1..20: mol_type = other DNA
  modified_base order(3..4,17..18): mod_base = OTHER; note = 2 prime-4 prime methylene bridge nucleoside
  modified_base order(1..2,6..7,10..11,14..16,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1251 - DNA, 20 bp, synthetic construct
  source 1..20: mol_type = other DNA
  modified_base order(7,14): mod_base = OTHER; note = 2 prime-4 prime methylene bridge nucleoside
  modified_base order(8,13): mod_base = OTHER; note = 2 prime-4 prime methylene bridge-5-methylcytidine
  modified_base order(1..4,6,10..11,15..18,20): mod_base = OTHER; note = 2 prime-O-methoxyethyl nucleoside
  modified_base order(5,9,12,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1252 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,5..16,19^20): mod_base = OTHER; note = phosphorothioate linkage
gaatctaccatccatgtact

SEQ ID NO: 1253 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6..7,10..11,14..18): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base order(1^2,4..17,19^20): mod_base = OTHER; note = phosphorothioate linkage
gaatctaccatccatgtact

SEQ ID NO: 1254 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..4,6..20): mod_base = OTHER; note = phosphorothioate linkage
gaatctaccatccatgtact

SEQ ID NO: 1255 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..6,8..20): mod_base = OTHER; note = phosphorothioate linkage
gaatctaccatccatgtact

SEQ ID NO: 1256 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..8,10..20): mod_base = OTHER; note = phosphorothioate linkage
gaatctaccatccatgtact

SEQ ID NO: 1257 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..10,12..20): mod_base = OTHER; note = phosphorothioate linkage
gaatctaccatccatgtact

SEQ ID NO: 1258 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..12,14..20): mod_base = OTHER; note = phosphorothioate linkage
gaatctaccatccatgtact

SEQ ID NO: 1259 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..14,16..20): mod_base = OTHER; note = phosphorothioate linkage
gaatctaccatccatgtact

SEQ ID NO: 1260 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1..16,18..20): mod_base = OTHER; note = phosphorothioate linkage
gaatctaccatccatgtact

SEQ ID NO: 1261 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1^2,4..21): mod_base = OTHER; note = phosphorothioate linkage
gaatctacccatccatgtact

SEQ ID NO: 1262 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..4,6..21): mod_base = OTHER; note = phosphorothioate linkage
gaatctacccatccatgtact

SEQ ID NO: 1263 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..6,8..21): mod_base = OTHER; note = phosphorothioate linkage
gaatctacccatccatgtact

SEQ ID NO: 1264 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..8,10..21): mod_base = OTHER; note = phosphorothioate linkage
gaatctacccatccatgtact

SEQ ID NO: 1265 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..10,12..21): mod_base = OTHER; note = phosphorothioate linkage
gaatctacccatccatgtact

SEQ ID NO: 1266 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..12,14..21): mod_base = OTHER; note = phosphorothioate linkage
gaatctacccatccatgtact

SEQ ID NO: 1267 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..14,16..21): mod_base = OTHER; note = phosphorothioate linkage
gaatctacccatccatgtact

SEQ ID NO: 1268 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..16,18..21): mod_base = OTHER; note = phosphorothioate linkage
gaatctacccatccatgtact

SEQ ID NO: 1269 - DNA, 21 bp, synthetic construct
  source 1..21: mol_type = other DNA
  modified_base order(1,21): mod_base = OTHER; note = 2 prime-4 prime methylene bridge nucleoside
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1..18,19..21): mod_base = OTHER; note = phosphorothioate linkage
gaatctacccatccatgtact

SEQ ID NO: 1270 - DNA, 21 bp, synthetic construct
  source 1..21: mol_type = other DNA
  modified_base 1..2: mod_base = OTHER; note = 2 prime-4 prime methylene bridge nucleoside
  modified_base order(3..4,6..7,11..12,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1271 - DNA, 21 bp, synthetic construct
  source 1..21: mol_type = other DNA
  modified_base 3..4: mod_base = OTHER; note = 2 prime-4 prime methylene bridge nucleoside
  modified_base order(1..2,6..7,11..12,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1272 - DNA, 21 bp, synthetic construct
  source 1..21: mol_type = other DNA
  modified_base 6: mod_base = OTHER; note = 2 prime-4 prime methylene bridge nucleoside
  modified_base 5: mod_base = OTHER; note = 2 prime-4 prime methylene bridge-5-methylcytidine
  modified_base order(1..4,7,11..12,15..19,21): mod_base = OTHER; note = 2 prime-O-methoxyethyl nucleoside
  modified_base order(8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1273 - DNA, 21 bp, synthetic construct
  source 1..21: mol_type = other DNA
  modified_base 7: mod_base = OTHER; note = 2 prime-4 prime methylene bridge nucleoside
  modified_base 8: mod_base = OTHER; note = 2 prime-4 prime methylene bridge-5-methylcytidine
  modified_base order(1..4,6,11..12,15..19,21): mod_base = OTHER; note = 2 prime-O-methoxyethyl nucleoside
  modified_base order(5,9..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1274 - DNA, 21 bp, synthetic construct
  source 1..21: mol_type = other DNA
  modified_base 9..10: mod_base = OTHER; note = 2 prime-4 prime methylene bridge-5-methylcytidine
  modified_base order(1..4,6..7,11..12,15..19,21): mod_base = OTHER; note = 2 prime-O-methoxyethyl nucleoside
  modified_base order(5,8,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1275 - DNA, 21 bp, synthetic construct
  source 1..21: mol_type = other DNA
  modified_base 11..12: mod_base = OTHER; note = 2 prime-4 prime methylene bridge nucleoside
  modified_base order(1..4,6..7,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1276 - DNA, 21 bp, synthetic construct
  source 1..21: mol_type = other DNA
  modified_base 13..14: mod_base = OTHER; note = 2 prime-4 prime methylene bridge-5-methylcytidine
  modified_base order(1..4,6..7,11..12,15..19,21): mod_base = OTHER; note = 2 prime-O-methoxyethyl nucleoside
  modified_base order(5,8..10,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1277 - DNA, 21 bp, synthetic construct
  source 1..21: mol_type = other DNA
  modified_base 15..16: mod_base = OTHER; note = 2 prime-4 prime methylene bridge nucleoside
  modified_base order(1..4,6..7,11..12,17..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1278 - DNA, 21 bp, synthetic construct
  source 1..21: mol_type = other DNA
  modified_base 17..18: mod_base = OTHER; note = 2 prime-4 prime methylene bridge nucleoside
  modified_base order(1..4,6..7,11..12,15..16,19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1279 - DNA, 21 bp, synthetic construct
  source 1..21: mol_type = other DNA
  modified_base 19: mod_base = OTHER; note = 2 prime-4 prime methylene bridge nucleoside
  modified_base 20: mod_base = OTHER; note = 2 prime-4 prime methylene bridge-5-methylcytidine
  modified_base order(1..4,6..7,11..12,15..18,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1280 - DNA, 21 bp, synthetic construct
  source 1..21: mol_type = other DNA
  modified_base 21: mod_base = OTHER; note = 2 prime-4 prime methylene bridge nucleoside
  modified_base 20: mod_base = OTHER; note = 2 prime-4 prime methylene bridge-5-methylcytidine
  modified_base order(1..4,6..7,11..12,15..19): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1281 - DNA, 21 bp, synthetic construct
  source 1..21: mol_type = other DNA
  modified_base 2: mod_base = OTHER; note = 2 prime-4 prime methylene bridge nucleoside
  modified_base 20: mod_base = OTHER; note = 2 prime-4 prime methylene bridge-5-methylcytidine
  modified_base order(1,3..4,6..7,11..12,15..19,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1282 - DNA, 21 bp, synthetic construct
  source 1..21: mol_type = other DNA
  modified_base order(4,18): mod_base = OTHER; note = 2 prime-4 prime methylene bridge nucleoside
  modified_base order(1..3,6..7,11..12,15..17,19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1283 - DNA, 21 bp, synthetic construct
  source 1..21: mol_type = other DNA
  modified_base order(6,16): mod_base = OTHER; note = 2 prime-4 prime methylene bridge nucleoside
  modified_base order(1..4,7,11..12,15,17..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1284 - DNA, 21 bp, synthetic construct
  source 1..21: mol_type = other DNA
  modified_base order(8,14): mod_base = OTHER; note = 2 prime-4 prime methylene bridge-5-methylcytidine
  modified_base order(1..4,6..7,11..12,15..19,21): mod_base = OTHER; note = 2 prime-O-methoxyethyl nucleoside
  modified_base order(5,9..10,13,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1285 - DNA, 20 bp, synthetic construct
  source 1..20: mol_type = other DNA
  modified_base 2: mod_base = OTHER; note = 2 prime-4 prime methylene bridge nucleoside
  modified_base 19: mod_base = OTHER; note = 2 prime-4 prime methylene bridge-5-methylcytidine
  modified_base order(1,3..4,6..7,10..11,14..18,20): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1286 - DNA, 20 bp, synthetic construct
  source 1..20: mol_type = other DNA
  modified_base order(4,17): mod_base = OTHER; note = 2 prime-4 prime methylene bridge nucleoside
  modified_base order(1..3,6..7,10..11,14..16,18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1287 - DNA, 20 bp, synthetic construct
  source 1..20: mol_type = other DNA
  modified_base order(6,15): mod_base = OTHER; note = 2 prime-4 prime methylene bridge nucleoside
  modified_base order(1..4,7,10..11,14,16..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1288 - DNA, 20 bp, synthetic construct
  source 1..20: mol_type = other DNA
  modified_base order(8,13): mod_base = OTHER; note = 2 prime-4 prime methylene bridge-5-methylcytidine
  modified_base order(1..4,6..7,10..11,14..18,20): mod_base = OTHER; note = 2 prime-O-methoxyethyl nucleoside
  modified_base order(5,9,12,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1289 - DNA, 20 bp, synthetic construct
  source 1..20: mol_type = other DNA
  modified_base 1..20: mod_base = OTHER; note = phosphorothioate linkage
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1,20): mod_base = OTHER; note = 2 prime-4 prime ethylene bridge nucleoside
gaatctaccatccatgtact

SEQ ID NO: 1290 - DNA, 20 bp, synthetic construct
  source 1..20: mol_type = other DNA
  modified_base 1..20: mod_base = OTHER; note = phosphorothioate linkage
  modified_base order(2..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(1,20): mod_base = OTHER; note = 2 prime-O, 4 prime-C-aminomethylene bridge nucleoside
gaatctaccatccatgtact

SEQ ID NO: 1291 - DNA, 21 bp, synthetic construct
  source 1..21: mol_type = other DNA
  modified_base 1..21: mod_base = OTHER; note = phosphorothioate linkage
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1,21): mod_base = OTHER; note = 2 prime-4 prime ethylene bridge nucleoside
gaatctacccatccatgtact

SEQ ID NO: 1292 - DNA, 21 bp, synthetic construct
  source 1..21: mol_type = other DNA
  modified_base 1..21: mod_base = OTHER; note = phosphorothioate linkage
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1,21): mod_base = OTHER; note = 2 prime-O, 4 prime-C-Spirocyclopropylene bridge nucleoside
gaatctacccatccatgtact

SEQ ID NO: 1293 - DNA, 21 bp, synthetic construct
  source 1..21: mol_type = other DNA
  modified_base 1..21: mod_base = OTHER; note = phosphorothioate linkage
  modified_base order(2..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(1,21): mod_base = OTHER; note = 2 prime-O, 4 prime-C-aminomethylene bridge nucleoside
gaatctacccatccatgtact

SEQ ID NO: 1294 - DNA, 20 bp, synthetic construct
  source 1..20: mol_type = other DNA
  modified_base 1: mod_base = OTHER; note = 2 prime-4 prime methylene bridge nucleoside
  modified_base 19: mod_base = OTHER; note = 2 prime-4 prime methylene bridge-5-methylcytidine
  modified_base order(2..4,6..7,10..11,14..18,20): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1295 - DNA, 20 bp, synthetic construct
  source 1..20: mol_type = other DNA
  modified_base 1..20: mod_base = OTHER; note = phosphorothioate linkage
  modified_base order(1,3..4,6..7,10..11,14..18,20): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 2: mod_base = OTHER; note = amido-bridge nucleoside
  modified_base 19: mod_base = OTHER; note = amido-bridge-5-methylcytidine
gaatctaccatccatgtact

SEQ ID NO: 1296 - DNA, 20 bp, synthetic construct
  source 1..20: mol_type = other DNA
  modified_base 1..20: mod_base = OTHER; note = phosphorothioate linkage
  modified_base order(2..4,6..7,10..11,14..18,20): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 1: mod_base = OTHER; note = 2 prime-4 prime ethylene bridge nucleoside
  modified_base 19: mod_base = OTHER; note = 2 prime-4 prime ethylene bridge 5-methylcytidine
gaatctaccatccatgtact

SEQ ID NO: 1297 - DNA, 20 bp, synthetic construct
  source 1..20: mol_type = other DNA
  modified_base 1..20: mod_base = OTHER; note = phosphorothioate linkage
  modified_base order(1,3..4,6..7,10..11,14..18,20): mod_base = OTHER; note = 2 prime-O-methoxyethyl nucleoside
  modified_base order(5,8..9,12..13): mod_base = OTHER; note = 2 prime-O-methoxyethyl-5-methylcytidine
  modified_base 2: mod_base = OTHER; note = 2 prime-4 prime ethylene bridge nucleoside
  modified_base 19: mod_base = OTHER; note = 2 prime-4 prime ethylene bridge 5-methylcytidine
gaatctaccatccatgtact

SEQ ID NO: 1298 - DNA, 20 bp, synthetic construct
  source 1..20: mol_type = other DNA
  modified_base 1..20: mod_base = OTHER; note = phosphorothioate linkage
  modified_base order(1,3..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base order(2,20): mod_base = OTHER; note = 2 prime-4 prime ethylene bridge nucleoside
gaatctaccatccatgtact

SEQ ID NO: 1299 - DNA, 21 bp, synthetic construct
  source 1..21: mol_type = other DNA
  modified_base 1: mod_base = OTHER; note = 2 prime-4 prime methylene bridge nucleoside
  modified_base 20: mod_base = OTHER; note = 2 prime-4 prime methylene bridge-5-methylcytidine
  modified_base order(2..4,6..7,11..12,15..19,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1300 - DNA, 21 bp, synthetic construct
  source 1..21: mol_type = other DNA
  modified_base order(2,21): mod_base = OTHER; note = 2 prime-4 prime methylene bridge nucleoside
  modified_base order(1,3..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1301 - DNA, 21 bp, synthetic construct
  source 1..21: mol_type = other DNA
  modified_base 1..21: mod_base = OTHER; note = phosphorothioate linkage
  modified_base order(1,3..4,6..7,11..12,15..19,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 2: mod_base = OTHER; note = amido-bridge nucleoside
  modified_base 20: mod_base = OTHER; note = amido-bridge-5-methylcytidine
gaatctacccatccatgtact

SEQ ID NO: 1302 - DNA, 21 bp, synthetic construct
  source 1..21: mol_type = other DNA
  modified_base 1..21: mod_base = OTHER; note = phosphorothioate linkage
  modified_base order(1,3..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(2,21): mod_base = OTHER; note = 2 prime-O, 4 prime-C-Spirocyclopropylene bridge nucleoside
gaatctacccatccatgtact

SEQ ID NO: 1303 - DNA, 21 bp, synthetic construct
  source 1..21: mol_type = other DNA
  modified_base 1..21: mod_base = OTHER; note = phosphorothioate linkage
  modified_base order(2..4,6..7,11..12,15..19,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 1: mod_base = OTHER; note = 2 prime-4 prime ethylene bridge nucleoside
  modified_base 20: mod_base = OTHER; note = 2 prime-4 prime ethylene bridge 5-methylcytidine
gaatctacccatccatgtact

SEQ ID NO: 1304 - DNA, 21 bp, synthetic construct
  source 1..21: mol_type = other DNA
  modified_base 1..21: mod_base = OTHER; note = phosphorothioate linkage
  modified_base order(1,3..4,6..7,11..12,15..19,21): mod_base = OTHER; note = 2 prime-O-methoxyethyl nucleoside
  modified_base order(5,8..10,13..14): mod_base = OTHER; note = 2 prime-O-methoxyethyl-5-methylcytidine
  modified_base 2: mod_base = OTHER; note = 2 prime-4 prime ethylene bridge nucleoside
  modified_base 20: mod_base = OTHER; note = 2 prime-4 prime ethylene bridge 5-methylcytidine
gaatctacccatccatgtact

SEQ ID NO: 1305 - DNA, 21 bp, synthetic construct
  source 1..21: mol_type = other DNA
  modified_base 1..21: mod_base = OTHER; note = phosphorothioate linkage
  modified_base order(1,3..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base order(2,21): mod_base = OTHER; note = 2 prime-4 prime ethylene bridge nucleoside
gaatctacccatccatgtact

SEQ ID NO: 1306 - DNA, 23 bp, synthetic construct
  source 1..23: mol_type = other DNA
  modified_base order(4,23): mod_base = OTHER; note = 2 prime-4 prime methylene bridge nucleoside
  modified_base order(5..7,9..10,13..14,17..21): mod_base = OTHER; note = 2 prime-O-methoxyethyl nucleoside
  modified_base order(8,11..12,15..16,22): mod_base = OTHER; note = 2 prime-O-methoxyethyl-5-methylcytidine
  modified_base 4..23: mod_base = OTHER; note = phosphorothioate linkage
  misc_feature <1: note = linked to [(1-oxohexadecyl)amino]hexyl]phosphoryl
tcagaatctaccatccatgtact

SEQ ID NO: 1307 - DNA, 24 bp, synthetic construct
  source 1..24: mol_type = other DNA
  modified_base order(4,24): mod_base = OTHER; note = 2 prime-4 prime methylene bridge nucleoside
  modified_base order(5..7,9..10,14..15,18..22): mod_base = OTHER; note = 2 prime-O-methoxyethyl nucleoside
  modified_base order(8,11..13,16..17,23): mod_base = OTHER; note = 2 prime-O-methoxyethyl-5-methylcytidine
  modified_base 4..24: mod_base = OTHER; note = phosphorothioate linkage
  misc_feature <1: note = linked to [(1-oxohexadecyl)amino]hexyl]phosphoryl
tcagaatctacccatccatgtact

SEQ ID NO: 1308 - DNA, 20 bp, synthetic construct
  source 1..20: mol_type = other DNA
  modified_base 1: mod_base = OTHER; note = 2 prime-4 prime methylene bridge nucleoside
  modified_base order(2..4,6..7,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1309 - DNA, 20 bp, synthetic construct
  source 1..20: mol_type = other DNA
  modified_base 20: mod_base = OTHER; note = 2 prime-4 prime methylene bridge nucleoside
  modified_base order(1..4,6..7,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1310 - DNA, 21 bp, synthetic construct
  source 1..21: mol_type = other DNA
  modified_base 1: mod_base = OTHER; note = 2 prime-4 prime methylene bridge nucleoside
  modified_base order(2..4,6..7,11..12,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1311 - DNA, 21 bp, synthetic construct
  source 1..21: mol_type = other DNA
  modified_base 21: mod_base = OTHER; note = 2 prime-4 prime methylene bridge nucleoside
  modified_base order(1..4,6..7,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1312 - DNA, 22 bp, synthetic construct
  source 1..22: mol_type = other DNA
  modified_base 22: mod_base = OTHER; note = 2 prime-4 prime methylene bridge nucleoside
  modified_base 1: mod_base = OTHER; note = 2 prime-4 prime methylene bridge-5-methylcytidine
  modified_base order(2..5,7..8,12..13,16..20): mod_base = OTHER; note = 2 prime-O-methoxyethyl nucleoside
  modified_base order(6,9..11,14..15,21): mod_base = OTHER; note = 2 prime-O-methoxyethyl-5-methylcytidine
  modified_base 1..22: mod_base = OTHER; note = phosphorothioate linkage
cgaatctacccatccatgtact

SEQ ID NO: 1313 - DNA, 22 bp, synthetic construct
  source 1..22: mol_type = other DNA
  modified_base order(1,22): mod_base = OTHER; note = 2 prime-4 prime methylene bridge nucleoside
  modified_base order(2..4,6..7,12..13,16..20): mod_base = OTHER; note = 2 prime-O-methoxyethyl nucleoside
  modified_base order(5,8..11,14..15,21): mod_base = OTHER; note = 2 prime-O-methoxyethyl-5-methylcytidine
  modified_base 1..22: mod_base = OTHER; note = phosphorothioate linkage
gaatctaccccatccatgtact

SEQ ID NO: 1314 - DNA, 23 bp, synthetic construct
  source 1..23: mol_type = other DNA
  modified_base order(1,23): mod_base = OTHER; note = 2 prime-4 prime methylene bridge nucleoside
  modified_base order(3..6,8..9,13..14,17..21): mod_base = OTHER; note = 2 prime-O-methoxyethyl nucleoside
  modified_base order(2,7,10..12,15..16,22): mod_base = OTHER; note = 2 prime-O-methoxyethyl-5-methylcytidine
  modified_base 1..23: mod_base = OTHER; note = phosphorothioate linkage
acgaatctacccatccatgtact

SEQ ID NO: 1315 - DNA, 23 bp, synthetic construct
  source 1..23: mol_type = other DNA
  modified_base 23: mod_base = OTHER; note = 2 prime-4 prime methylene bridge nucleoside
  modified_base 1: mod_base = OTHER; note = 2 prime-4 prime methylene bridge-5-methylcytidine
  modified_base order(2..5,7..8,13..14,17..21): mod_base = OTHER; note = 2 prime-O-methoxyethyl nucleoside
  modified_base order(6,9..12,15..16,22): mod_base = OTHER; note = 2 prime-O-methoxyethyl-5-methylcytidine
  modified_base 1..23: mod_base = OTHER; note = phosphorothioate linkage
cgaatctaccccatccatgtact

SEQ ID NO: 1316 - DNA, 23 bp, synthetic construct
  source 1..23: mol_type = other DNA
  modified_base order(1,23): mod_base = OTHER; note = 2 prime-4 prime methylene bridge nucleoside
  modified_base order(2..4,6..7,13..14,17..21): mod_base = OTHER; note = 2 prime-O-methoxyethyl nucleoside
  modified_base order(5,8..12,15..16,22): mod_base = OTHER; note = 2 prime-O-methoxyethyl-5-methylcytidine
  modified_base 1..23: mod_base = OTHER; note = phosphorothioate linkage
gaatctacccccatccatgtact

SEQ ID NO: 1317 - DNA, 24 bp, synthetic construct
  source 1..24: mol_type = other DNA
  modified_base 24: mod_base = OTHER; note = 2 prime-4 prime methylene bridge nucleoside
  modified_base 1: mod_base = OTHER; note = 2 prime-4 prime methylene bridge-5-methylcytidine
  modified_base order(2,4..7,9..10,14..15,18..22): mod_base = OTHER; note = 2 prime-O-methoxyethyl nucleoside
  modified_base order(3,8,11..13,16..17,23): mod_base = OTHER; note = 2 prime-O-methoxyethyl-5-methylcytidine
  modified_base 1..23: mod_base = OTHER; note = phosphorothioate linkage
cacgaatctacccatccatgtact

SEQ ID NO: 1318 - DNA, 24 bp, synthetic construct
  source 1..24: mol_type = other DNA
  modified_base 24: mod_base = OTHER; note = 2 prime-4 prime methylene bridge nucleoside
  modified_base 1: mod_base = OTHER; note = 2 prime-4 prime methylene bridge-5-methylcytidine
  modified_base order(2..5,7..8,14..15,18..22): mod_base = OTHER; note = 2 prime-O-methoxyethyl nucleoside
  modified_base order(6,9..13,16..17,23): mod_base = OTHER; note = 2 prime-O-methoxyethyl-5-methylcytidine
  modified_base 1..23: mod_base = OTHER; note = phosphorothioate linkage
cgaatctacccccatccatgtact

SEQ ID NO: 1319 - DNA, 24 bp, synthetic construct
  source 1..24: mol_type = other DNA
  modified_base order(1,24): mod_base = OTHER; note = 2 prime-4 prime methylene bridge nucleoside
  modified_base order(2..4,6..7,11,14..15,18..22): mod_base = OTHER; note = 2 prime-O-methoxyethyl nucleoside
  modified_base order(5,8..10,12..13,16..17,23): mod_base = OTHER; note = 2 prime-O-methoxyethyl-5-methylcytidine
  modified_base 1..23: mod_base = OTHER; note = phosphorothioate linkage
gaatctacccaccatccatgtact

SEQ ID NO: 1320 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(2..5,7..8,10..11,14..18): mod_base = OTHER; note = 2 prime-O-methoxyethyl nucleoside
  modified_base order(6,9,12..13,19): mod_base = OTHER; note = 2 prime-O-methoxyethyl-5-methylcytidine
  modified_base 1..20: mod_base = OTHER; note = phosphorothioate linkage
cgaatctacatccatgtact

SEQ ID NO: 1321 - DNA, 20 bp, synthetic construct
  source 1..20: mol_type = other DNA
  modified_base 1: mod_base = OTHER; note = 2 prime-4 prime methylene bridge nucleoside
  modified_base 20: mod_base = OTHER; note = 2 prime-4 prime methylene bridge-5-methylcytidine
  modified_base order(3..6,8..9,11..12,15..19): mod_base = OTHER; note = 2 prime-O-methoxyethyl nucleoside
  modified_base order(2,7,10,13..14): mod_base = OTHER; note = 2 prime-O-methoxyethyl-5-methylcytidine
  modified_base 1..20: mod_base = OTHER; note = phosphorothioate linkage
acgaatctacatccatgtac

SEQ ID NO: 1322 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,12..13,16..19): mod_base = OTHER; note = 2 prime-O-methoxyethyl nucleoside
  modified_base order(5,8..11,14..15): mod_base = OTHER; note = 2 prime-O-methoxyethyl-5-methylcytidine
  modified_base 1..20: mod_base = OTHER; note = phosphorothioate linkage
gaatctaccccatccatgta

SEQ ID NO: 1323 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(2,4..7,9..11,14..18): mod_base = OTHER; note = 2 prime-O-methoxyethyl nucleoside
  modified_base order(3,8,12..13,19): mod_base = OTHER; note = 2 prime-O-methoxyethyl-5-methylcytidine
  modified_base 1..20: mod_base = OTHER; note = phosphorothioate linkage
cacgaatctatccatgtact

SEQ ID NO: 1324 - DNA, 20 bp, synthetic construct
  source 1..20: mol_type = other DNA
  modified_base order(1,20): mod_base = OTHER; note = 2 prime-4 prime methylene bridge-5-methylcytidine
  modified_base order(2,4..7,9..12,15..19): mod_base = OTHER; note = 2 prime-O-methoxyethyl nucleoside
  modified_base order(3,8,13..14): mod_base = OTHER; note = 2 prime-O-methoxyethyl-5-methylcytidine
  modified_base 1..20: mod_base = OTHER; note = phosphorothioate linkage
cacgaatctaatccatgtac

SEQ ID NO: 1325 - DNA, 20 bp, synthetic construct
  source 1..20: mol_type = other DNA
  modified_base 20: mod_base = OTHER; note = 2 prime-4 prime methylene bridge nucleoside
  modified_base 1: mod_base = OTHER; note = 2 prime-4 prime methylene bridge-5-methylcytidine
  modified_base order(2,4..7,9..10,12..13,16..19): mod_base = OTHER; note = 2 prime-O-methoxyethyl nucleoside
  modified_base order(3,8,11,14..15): mod_base = OTHER; note = 2 prime-O-methoxyethyl-5-methylcytidine
  modified_base 1..20: mod_base = OTHER; note = phosphorothioate linkage
cacgaatctacatccatgta

SEQ ID NO: 1326 - DNA, 20 bp, synthetic construct
  source 1..20: mol_type = other DNA
  modified_base order(1,20): mod_base = OTHER; note = 2 prime-4 prime methylene bridge nucleoside
  modified_base order(2..4,6..7,13..14,17..19): mod_base = OTHER; note = 2 prime-O-methoxyethyl nucleoside
  modified_base order(5,8..12,15..16): mod_base = OTHER; note = 2 prime-O-methoxyethyl-5-methylcytidine
  modified_base 1..20: mod_base = OTHER; note = phosphorothioate linkage
gaatctacccccatccatgt

SEQ ID NO: 1327 - DNA, 20 bp, synthetic construct
  source 1..20: mol_type = other DNA
  modified_base order(1,7): mod_base = OTHER; note = 2 prime-4 prime methylene bridge nucleoside
  modified_base order(2..4,6,10..11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1328 - DNA, 20 bp, synthetic construct
  source 1..20: mol_type = other DNA
  modified_base order(7,20): mod_base = OTHER; note = 2 prime-4 prime methylene bridge nucleoside
  modified_base order(1..4,6,10..11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1329 - DNA, 20 bp, synthetic construct
  source 1..20: mol_type = other DNA
  modified_base 8..9: mod_base = OTHER; note = 2 prime-4 prime methylene bridge-5-methylcytidine
  modified_base order(1..4,6..7,10..11,14..18,20): mod_base = OTHER; note = 2 prime-O-methoxyethyl nucleoside
  modified_base order(5,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1330 - DNA, 20 bp, synthetic construct
  source 1..20: mol_type = other DNA
  modified_base 1: mod_base = OTHER; note = 2 prime-4 prime methylene bridge nucleoside
  modified_base 8: mod_base = OTHER; note = 2 prime-4 prime methylene bridge-5-methylcytidine
  modified_base order(2..4,6..7,10..11,14..18,20): mod_base = OTHER; note = 2 prime-O-methoxyethyl nucleoside
  modified_base order(5,9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1331 - DNA, 20 bp, synthetic construct
  source 1..20: mol_type = other DNA
  modified_base 20: mod_base = OTHER; note = 2 prime-4 prime methylene bridge nucleoside
  modified_base 8: mod_base = OTHER; note = 2 prime-4 prime methylene bridge-5-methylcytidine
  modified_base order(1..4,6..7,10..11,14..18): mod_base = OTHER; note = 2 prime-O-methoxyethyl nucleoside
  modified_base order(5,9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1332 - DNA, 20 bp, synthetic construct
  source 1..20: mol_type = other DNA
  modified_base 1: mod_base = OTHER; note = 2 prime-4 prime methylene bridge nucleoside
  modified_base 9: mod_base = OTHER; note = 2 prime-4 prime methylene bridge-5-methylcytidine
  modified_base order(2..4,6..7,10..11,14..18,20): mod_base = OTHER; note = 2 prime-O-methoxyethyl nucleoside
  modified_base order(5,8,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1333 - DNA, 20 bp, synthetic construct
  source 1..20: mol_type = other DNA
  modified_base order(1,10): mod_base = OTHER; note = 2 prime-4 prime methylene bridge nucleoside
  modified_base order(2..4,6..7,11,14..18,20): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1334 - DNA, 20 bp, synthetic construct
  source 1..20: mol_type = other DNA
  modified_base order(10,20): mod_base = OTHER; note = 2 prime-4 prime methylene bridge nucleoside
  modified_base order(1..4,6..7,11,14..18): mod_base = OTHER; note = 2 prime-O-methoxyethyl nucleoside
  modified_base order(5,8..9,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1335 - DNA, 20 bp, synthetic construct
  source 1..20: mol_type = other DNA
  modified_base 20: mod_base = OTHER; note = 2 prime-4 prime methylene bridge nucleoside
  modified_base 9: mod_base = OTHER; note = 2 prime-4 prime methylene bridge-5-methylcytidine
  modified_base order(1..4,6..7,10..11,14..18): mod_base = OTHER; note = 2 prime-O-methoxyethyl nucleoside
  modified_base order(5,8,12..13,19): mod_base = OTHER; note = 2 prime-O-methoxyethyl-5-methylcytidine
  modified_base 1..20: mod_base = OTHER; note = phosphorothioate linkage
gaatctaccatccatgtact

SEQ ID NO: 1336 - DNA, 21 bp, synthetic construct
  source 1..21: mol_type = other DNA
  modified_base order(1,7): mod_base = OTHER; note = 2 prime-4 prime methylene bridge nucleoside
  modified_base order(2..4,6,11..12,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1337 - DNA, 21 bp, synthetic construct
  source 1..21: mol_type = other DNA
  modified_base order(7,21): mod_base = OTHER; note = 2 prime-4 prime methylene bridge nucleoside
  modified_base order(1..4,6,11..12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1338 - DNA, 21 bp, synthetic construct
  source 1..21: mol_type = other DNA
  modified_base 8..9: mod_base = OTHER; note = 2 prime-4 prime methylene bridge-5-methylcytidine
  modified_base order(1..4,6..7,11..12,15..19,21): mod_base = OTHER; note = 2 prime-O-methoxyethyl nucleoside
  modified_base order(5,10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1339 - DNA, 21 bp, synthetic construct
  source 1..21: mol_type = other DNA
  modified_base 1: mod_base = OTHER; note = 2 prime-4 prime methylene bridge nucleoside
  modified_base 8: mod_base = OTHER; note = 2 prime-4 prime methylene bridge-5-methylcytidine
  modified_base order(2..4,6..7,11..12,15..19,21): mod_base = OTHER; note = 2 prime-O-methoxyethyl nucleoside
  modified_base order(5,9..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1340 - DNA, 21 bp, synthetic construct
  source 1..21: mol_type = other DNA
  modified_base 1: mod_base = OTHER; note = 2 prime-4 prime methylene bridge nucleoside
  modified_base 9: mod_base = OTHER; note = 2 prime-4 prime methylene bridge-5-methylcytidine
  modified_base order(2..4,6..7,11..12,15..19,21): mod_base = OTHER; note = 2 prime-O-methoxyethyl nucleoside
  modified_base order(5,8,10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1341 - DNA, 21 bp, synthetic construct
  source 1..21: mol_type = other DNA
  modified_base 21: mod_base = OTHER; note = 2 prime-4 prime methylene bridge nucleoside
  modified_base 9: mod_base = OTHER; note = 2 prime-4 prime methylene bridge-5-methylcytidine
  modified_base order(1..4,6..7,11..12,15..19): mod_base = OTHER; note = 2 prime-O-methoxyethyl nucleoside
  modified_base order(5,8,10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1342 - DNA, 21 bp, synthetic construct
  source 1..21: mol_type = other DNA
  modified_base 21: mod_base = OTHER; note = 2 prime-4 prime methylene bridge nucleoside
  modified_base 8: mod_base = OTHER; note = 2 prime-4 prime methylene bridge-5-methylcytidine
  modified_base order(1..4,6..7,11..12,15..19): mod_base = OTHER; note = 2 prime-O-methoxyethyl nucleoside
  modified_base order(5,9..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1343 - DNA, 21 bp, synthetic construct
  source 1..21: mol_type = other DNA
  modified_base 9: mod_base = OTHER; note = 2 prime-4 prime methylene bridge nucleoside
  modified_base 10: mod_base = OTHER; note = 2 prime-4 prime methylene bridge-5-methylcytidine
  modified_base order(1..4,6..7,11..12,15..19,21): mod_base = OTHER; note = 2 prime-O-methoxyethyl nucleoside
  modified_base order(5,8,13..14,20): mod_base = OTHER; note = 2 prime-O-methoxyethyl-5-methylcytidine
  modified_base 1..21: mod_base = OTHER; note = phosphorothioate linkage
gaatctacacatccatgtact

SEQ ID NO: 1344 - DNA, 21 bp, synthetic construct
  source 1..21: mol_type = other DNA
  modified_base order(1,9): mod_base = OTHER; note = 2 prime-4 prime methylene bridge nucleoside
  modified_base order(2..4,6..7,11..12,15..19,21): mod_base = OTHER; note = 2 prime-O-methoxyethyl nucleoside
  modified_base order(5,8,10,13..14,20): mod_base = OTHER; note = 2 prime-O-methoxyethyl-5-methylcytidine
  modified_base 1..21: mod_base = OTHER; note = phosphorothioate linkage
gaatctacacatccatgtact

SEQ ID NO: 1345 - DNA, 21 bp, synthetic construct
  source 1..21: mol_type = other DNA
  modified_base 21: mod_base = OTHER; note = 2 prime-4 prime methylene bridge nucleoside
  modified_base 10: mod_base = OTHER; note = 2 prime-4 prime methylene bridge-5-methylcytidine
  modified_base order(1..4,6..7,9,11..12,15..19): mod_base = OTHER; note = 2 prime-O-methoxyethyl nucleoside
  modified_base order(5,8,13..14,20): mod_base = OTHER; note = 2 prime-O-methoxyethyl-5-methylcytidine
  modified_base 1..21: mod_base = OTHER; note = phosphorothioate linkage
gaatctacacatccatgtact

SEQ ID NO: 1346 - DNA, 21 bp, synthetic construct
  source 1..21: mol_type = other DNA
  modified_base order(9,21): mod_base = OTHER; note = 2 prime-4 prime methylene bridge nucleoside
  modified_base order(1..4,6..7,11..12,15..19): mod_base = OTHER; note = 2 prime-O-methoxyethyl nucleoside
  modified_base order(5,8,10,13..14,20): mod_base = OTHER; note = 2 prime-O-methoxyethyl-5-methylcytidine
  modified_base 1..21: mod_base = OTHER; note = phosphorothioate linkage
gaatctacacatccatgtact

SEQ ID NO: 1347 - DNA, 21 bp, synthetic construct
  source 1..21: mol_type = other DNA
  modified_base 1: mod_base = OTHER; note = 2 prime-4 prime methylene bridge nucleoside
  modified_base 10: mod_base = OTHER; note = 2 prime-4 prime methylene bridge-5-methylcytidine
  modified_base order(2..4,6..7,11..12,15..19,21): mod_base = OTHER; note = 2 prime-O-methoxyethyl nucleoside
  modified_base order(5,8..9,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1348 - DNA, 21 bp, synthetic construct
  source 1..21: mol_type = other DNA
  modified_base order(1,11): mod_base = OTHER; note = 2 prime-4 prime methylene bridge nucleoside
  modified_base order(2..4,6..7,12,15..19,21): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1349 - DNA, 21 bp, synthetic construct
  source 1..21: mol_type = other DNA
  modified_base order(11,21): mod_base = OTHER; note = 2 prime-4 prime methylene bridge nucleoside
  modified_base order(1..4,6..7,12,15..19): mod_base = OTHER; note = 2 prime-O-methoxyethyl nucleoside
  modified_base order(5,8..10,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1350 - DNA, 21 bp, synthetic construct
  source 1..21: mol_type = other DNA
  modified_base 21: mod_base = OTHER; note = 2 prime-4 prime methylene bridge nucleoside
  modified_base 10: mod_base = OTHER; note = 2 prime-4 prime methylene bridge-5-methylcytidine
  modified_base order(1..4,6..7,11..12,15..19): mod_base = OTHER; note = 2 prime-O-methoxyethyl nucleoside
  modified_base order(5,8..9,13..14,20): mod_base = OTHER; note = 2 prime-O-methoxyethyl-5-methylcytidine
  modified_base 1..21: mod_base = OTHER; note = phosphorothioate linkage
gaatctacccatccatgtact

SEQ ID NO: 1351 - DNA, 13 bp, synthetic construct
  source 1..13: mol_type = other DNA
  modified_base 13: mod_base = OTHER; note = 2 prime-4 prime methylene bridge nucleoside
  modified_base order(3..4,7..11): mod_base = OTHER; note = 2 prime-O-methoxyethyl nucleoside
  modified_base order(1..2,5..6,12): mod_base = OTHER; note = 2 prime-O-methoxyethyl-5-methylcytidine
  modified_base 2..13: mod_base = OTHER; note = phosphorothioate linkage
ccatccatgtact

SEQ ID NO: 1352 - DNA, 14 bp, synthetic construct
  source 1..14: mol_type = other DNA
  modified_base 14: mod_base = OTHER; note = 2 prime-4 prime methylene bridge nucleoside
  modified_base order(4..5,8..12): mod_base = OTHER; note = 2 prime-O-methoxyethyl nucleoside
  modified_base order(1..3,6..7,13): mod_base = OTHER; note = 2 prime-O-methoxyethyl-5-methylcytidine
  modified_base 2..14: mod_base = OTHER; note = phosphorothioate linkage
cccatccatgtact

SEQ ID NO: 1353 - DNA, 11 bp, synthetic construct
  source 1..11: mol_type = other DNA
  modified_base 11: mod_base = OTHER; note = 2 prime-4 prime methylene bridge nucleoside
  modified_base order(1..2,5..9): mod_base = OTHER; note = 2 prime-O-methoxyethyl nucleoside
  modified_base order(3..4,10): mod_base = OTHER; note = 2 prime-O-methoxyethyl-5-methylcytidine
  modified_base 2..11: mod_base = OTHER; note = phosphorothioate linkage
atccatgtact

SEQ ID NO: 1354 - DNA, 12 bp, synthetic construct
  source 1..12: mol_type = other DNA
  modified_base 12: mod_base = OTHER; note = 2 prime-4 prime methylene bridge nucleoside
  modified_base order(2..3,6..10): mod_base = OTHER; note = 2 prime-O-methoxyethyl nucleoside
  modified_base order(1,4..5,11): mod_base = OTHER; note = 2 prime-O-methoxyethyl-5-methylcytidine
  modified_base 2..12: mod_base = OTHER; note = phosphorothioate linkage
catccatgtact

SEQ ID NO: 1355 - DNA, 20 bp, synthetic construct
  source 1..20: mol_type = other DNA
  modified_base order(2..4,6..7,10..11,14..18): mod_base = OTHER; note = 2 prime-O-N-methylacetamide nucleoside
  modified_base order(5,8..9,12..13,19): mod_base = OTHER; note = 2 prime-O-N-methylacetamide-5-methylcytidine
  modified_base 1..20: mod_base = OTHER; note = phosphorothioate linkage
  modified_base order(1,20): mod_base = OTHER; note = 2 prime-4 prime methylene bridge nucleoside
gaatctaccatccatgtact

SEQ ID NO: 1356 - DNA, 21 bp, synthetic construct
  source 1..21: mol_type = other DNA
  modified_base order(2..4,6..7,11..12,15..19): mod_base = OTHER; note = 2 prime-O-N-methylacetamide nucleoside
  modified_base order(5,8..10,13..14,20): mod_base = OTHER; note = 2 prime-O-N-methylacetamide-5-methylcytidine
  modified_base 1..21: mod_base = OTHER; note = phosphorothioate linkage
  modified_base order(1,21): mod_base = OTHER; note = 2 prime-4 prime methylene bridge nucleoside
gaatctacccatccatgtact

SEQ ID NO: 1357 - DNA, 20 bp, synthetic construct
  source 1..20: mol_type = other DNA
  modified_base order(1,20): mod_base = OTHER; note = 2 prime-4 prime methylene bridge nucleoside
  modified_base order(2,19): mod_base = OTHER; note = 2 prime-4 prime methylene bridge-5-methylcytidine
  modified_base order(3..4,10..11,14..18): mod_base = OTHER; note = 2 prime-O-methoxyethyl nucleoside
  modified_base order(5..9,12..13): mod_base = OTHER; note = 2 prime-O-methoxyethyl-5-methylcytidine
  modified_base 1..20: mod_base = OTHER; note = phosphorothioate linkage
tctacccccatccatgtact

SEQ ID NO: 1358 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(4..5,10..11,14..18): mod_base = OTHER; note = 2 prime-O-methoxyethyl nucleoside
  modified_base order(3,6..9,12..13): mod_base = OTHER; note = 2 prime-O-methoxyethyl-5-methylcytidine
  modified_base 1..20: mod_base = OTHER; note = phosphorothioate linkage
atctaccccatccatgtact

SEQ ID NO: 1359 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(4,7,10..11,14..18): mod_base = OTHER; note = 2 prime-O-methoxyethyl nucleoside
  modified_base order(3,5..6,8..9,12..13): mod_base = OTHER; note = 2 prime-O-methoxyethyl-5-methylcytidine
  modified_base 1..20: mod_base = OTHER; note = phosphorothioate linkage
gtcgccgccatccatgtact

SEQ ID NO: 1360 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..5,7,10..11,14..18): mod_base = OTHER; note = 2 prime-O-methoxyethyl nucleoside
  modified_base order(6,8..9,12..13): mod_base = OTHER; note = 2 prime-O-methoxyethyl-5-methylcytidine
  modified_base 1..20: mod_base = OTHER; note = phosphorothioate linkage
ggggtcgccatccatgtact

SEQ ID NO: 1361 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3..4,6,10..11,14..18): mod_base = OTHER; note = 2 prime-O-methoxyethyl nucleoside
  modified_base order(5,7..9,12..13): mod_base = OTHER; note = 2 prime-O-methoxyethyl-5-methylcytidine
  modified_base 1..20: mod_base = OTHER; note = phosphorothioate linkage
gggtcgcccatccatgtact

SEQ ID NO: 1362 - DNA, 20 bp, synthetic construct
  source 1..20: mol_type = other DNA
  modified_base order(1..2,20): mod_base = OTHER; note = 2 prime-4 prime methylene bridge nucleoside
  modified_base 19: mod_base = OTHER; note = 2 prime-4 prime methylene bridge-5-methylcytidine
  modified_base order(3,5,10..11,14..18): mod_base = OTHER; note = 2 prime-O-methoxyethyl nucleoside
  modified_base order(4,6..9,12..13): mod_base = OTHER; note = 2 prime-O-methoxyethyl-5-methylcytidine
  modified_base 1..20: mod_base = OTHER; note = phosphorothioate linkage
ggtcgccccatccatgtact

SEQ ID NO: 1363 - DNA, 20 bp, synthetic construct
  source 1..20: mol_type = other DNA
  modified_base 1..20: mod_base = OTHER; note = phosphorothioate linkage
  modified_base order(1..4,18..20): mod_base = OTHER; note = 2 prime-4 prime ethylene-bridge nucleoside
  modified_base 16..17: mod_base = OTHER; note = 2 prime-4 prime ethylene-bridge 5-methylcytosine
  modified_base order(6,8,10): mod_base = OTHER; note = 5-methyl cytosine
atatgcacgctgattccttt

SEQ ID NO: 1364 - DNA, 20 bp, synthetic construct
  source 1..20: mol_type = other DNA
  modified_base 1..20: mod_base = OTHER; note = phosphate linkage
  modified_base order(9,12,16): mod_base = OTHER; note = 5-methyl cytosine
aaaggaatcagcgtgcatat

What is claimed is:

1. An antisense oligonucleotide comprising the following structure: [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] (SEQ ID NO: 571), wherein iA, iG, i$^5$C, and iT are 2'-O-methoxyethyl (2'-MOE) modified adenosine, guanosine, 5'-methyl cytidine, and thymidine, respectively; and s is a phosphorothioate internucleoside linkage, or a pharmaceutically acceptable salt thereof.

2. A method of inhibiting inclusion of an UNC13A cryptic exon into an UNC13A mature mRNA in a neuronal cell of a human subject, comprising administering to the subject the antisense oligonucleotide of claim 1.

3. The method of claim 2, wherein the method restores UNC13A expression in the neuronal cell.

4. A method of treating a neurodegenerative disease in a human subject, comprising administering to the subject the antisense oligonucleotide of claim 1, wherein the neurodegenerative disease is amyotrophic lateral sclerosis (ALS) or frontotemporal dementia (FTD).

5. An antisense oligonucleotide consisting of the following structure: [i$^5$Cs][iGs][iAs][iAs][iTs][i$^5$Cs][iTs][iAs][i$^5$Cs][i$^5$Cs][i$^5$Cs][iAs][i$^5$Cs][iAs][iTs][i$^5$Cs][iTs][iGs][iTs][iTs][i$^5$Cs][iAs][iAs][iTs][i$^5$Cs][iA] (SEQ ID NO: 571), wherein iA, iG, i$^5$C, and iT are 2'-O-methoxyethyl (2'-MOE) modified adenosine, guanosine, 5'-methyl cytidine, and thymidine, respectively; and s is a phosphorothioate internucleoside linkage, or a pharmaceutically acceptable salt thereof.

6. A method of inhibiting inclusion of an UNC13A cryptic exon into an UNC13A mature mRNA in a neuronal cell of a human subject, comprising administering to the subject the antisense oligonucleotide of claim 5.

7. The method of claim 6, wherein the method restores UNC13A expression in the neuronal cell.

8. A method of treating a neurodegenerative disease in a human subject, comprising administering to the subject the antisense oligonucleotide of claim 5, wherein the neurodegenerative disease is amyotrophic lateral sclerosis (ALS) or frontotemporal dementia (FTD).

* * * * *